US010513724B2

(12) United States Patent
Natunen et al.

(10) Patent No.: US 10,513,724 B2
(45) Date of Patent: Dec. 24, 2019

(54) PRODUCTION OF GLYCOPROTEINS WITH MAMMALIAN-LIKE N-GLYCANS IN FILAMENTOUS FUNGI

(71) Applicant: GLYKOS FINLAND OY, Helsinki (FI)

(72) Inventors: Jari Natunen, Vantaa (FI); Anne Leppänen, Vantaa (FI); Heidi Salminen, Espoo (FI); Jukka Hiltunen, Helsinki (FI); Anne Kanerva, Helsinki (FI); Annamari Heiskanen, Helsinki (FI); Ann Westerholm-Parvinen, Kirkkonummi (FI); Georg Schmidt, Nahkela (FI); Anne Huuskonen, Helsinki (FI); Eero Mustalahti, Helsinki (FI); Christopher Landowski, Helsinki (FI); Markku Saloheimo, Helsinki (FI); Juhani Saarinen, Helsinki (FI); Benjamin Patrick Sommer, Basel (CH); Ramon Wahl, Basel (CH); Christian Ostermeier, Basel (CH); Bernhard Helk, Basel (CH)

(73) Assignee: GLYKOS FINLAND OY, Helsinki (FI)

( * ) Notice: Subject to any disclaimer, the term of this patent is extended or adjusted under 35 U.S.C. 154(b) by 74 days.

(21) Appl. No.: 15/327,448

(22) PCT Filed: Jul. 21, 2015

(86) PCT No.: PCT/EP2015/066686
§ 371 (c)(1),
(2) Date: Jan. 19, 2017

(87) PCT Pub. No.: WO2016/012468
PCT Pub. Date: Jan. 28, 2016

(65) Prior Publication Data
US 2017/0159094 A1   Jun. 8, 2017

(30) Foreign Application Priority Data
Jul. 21, 2014   (EP) .................... 14177875

(51) Int. Cl.
*C12P 21/00* (2006.01)
*C12N 9/10* (2006.01)
*C12N 9/24* (2006.01)

(52) U.S. Cl.
CPC .......... *C12P 21/005* (2013.01); *C12N 9/1051* (2013.01); *C12N 9/1081* (2013.01); *C12N 9/2402* (2013.01); *C12Y 204/99* (2013.01); *C12Y 204/99018* (2015.07); *C12Y 302/01024* (2013.01); *C12Y 302/01113* (2013.01)

(58) Field of Classification Search
CPC .......... C07K 16/00; C07K 2317/41; C07K 2317/55; C12N 15/80; C12N 9/58; C12P 21/005
See application file for complete search history.

(56) References Cited

U.S. PATENT DOCUMENTS

| | | | |
|---|---|---|---|
| 4,758,512 A | 7/1988 | Goldberg et al. |
| 5,116,964 A | 5/1992 | Capon et al. |
| 5,428,130 A | 6/1995 | Capon et al. |
| 5,455,165 A | 10/1995 | Capon et al. |
| 5,514,582 A | 5/1996 | Capon et al. |
| 5,610,034 A | 3/1997 | Nyyssönen et al. |
| 5,641,668 A | 6/1997 | Berger et al. |
| 5,674,728 A | 10/1997 | Buxton et al. |
| 5,693,520 A | 12/1997 | Branner et al. |
| 5,714,377 A | 2/1998 | Tanner et al. |
| 5,728,568 A | 3/1998 | Sullivan et al. |
| 5,756,338 A | 5/1998 | Buxton et al. |
| 5,776,730 A | 7/1998 | Stuart |
| 5,821,104 A | 10/1998 | Holm et al. |
| 5,834,251 A | 11/1998 | Maras et al. |

(Continued)

FOREIGN PATENT DOCUMENTS

| | | |
|---|---|---|
| EP | 0574347 A2 | 12/1993 |
| EP | 1266011 A1 | 12/2002 |

(Continued)

OTHER PUBLICATIONS

Liu et al (Disruption of the OCH1 and MNN1 genes decrease N-glycosylation on glycoprotein expressed in Kluyveromyces lactis (J. Biotechnol. 2009, 143(2):95-102). (Year: 2009).*
Vivi Joosten et al. The production of antibody fragments and antibody fusion proteins by yeasts and filamentous fungi, Review—Microbiology Cell Factories BioMed Published: Jan. 2003 Microbial Cell Factories 2003, (Year: 2003).*
Karen De Pourcq et al. Engineering of glycosylation in yeast and other fungi: current state and perspectives Appl Microbiol Biotechnol (2010) 87:1617-1631.*
Karen De Pourcq et al (EngineeringYarrowia lipolytica to Produce Glycoproteins Homogeneously Modified with the Universal Man3GlcNAc2 N-Glycan Core. PLoS ONE Jun. 2012, vol. 7, Issue 6). (Year: 2012).*

(Continued)

Primary Examiner — Kagnew H Gebreyesus
(74) Attorney, Agent, or Firm — Patrick J Halloran

(57) ABSTRACT

The present disclosure relates to compositions and methods useful for the production of recombinant glycoproteins in filamentous fungal cells, such as *Trichoderma* cells, wherein at least 90% (mol %), preferably at least 95% of the total neutral N-glycans of said produced recombinant glycoprotein are mammalian-like N-glycans. More specifically, the invention provides a filamentous fungal cell comprising i. one or more mutations that reduces or eliminates one or more endogenous protease activity compared to a parental filamentous fungal cell which does not have said mutation(s); ii. a polynucleotide encoding a heterologous catalytic subunit of oligosaccharyl transferase; iii. a recombinant polynucleotide for increasing α1, 2 mannosidase activity; and, iv. a recombinant polynucleotide encoding said heterologous glycoprotein.

17 Claims, 19 Drawing Sheets
Specification includes a Sequence Listing.

(56) References Cited

U.S. PATENT DOCUMENTS

| | | |
|---|---|---|
| 5,837,847 A | 11/1998 | Royer et al. |
| 5,840,570 A | 11/1998 | Berka et al. |
| 5,846,802 A | 12/1998 | Buxton et al. |
| 5,861,280 A | 1/1999 | Lehmbeck |
| 5,958,727 A | 9/1999 | Brody |
| 5,968,774 A | 10/1999 | Lehmbeck |
| 5,989,889 A | 11/1999 | Rey |
| 6,013,452 A | 1/2000 | Christensen |
| 6,013,489 A | 1/2000 | Musters et al. |
| 6,025,185 A | 2/2000 | Christensen |
| 6,291,209 B1 | 9/2001 | Lehmbeck |
| 6,352,841 B1 | 3/2002 | Lehmbeck |
| 6,509,171 B1 | 1/2003 | Berka et al. |
| 6,558,934 B1 | 5/2003 | Clausen et al. |
| 6,602,684 B1 | 8/2003 | Umana et al. |
| 6,803,225 B2 | 10/2004 | Contreras et al. |
| 6,806,062 B1 | 10/2004 | Hjort et al. |
| 6,902,922 B2 | 6/2005 | Ness et al. |
| 6,916,649 B2 | 7/2005 | Clausen et al. |
| 6,946,292 B2 | 9/2005 | Kanda et al. |
| 7,029,872 B2 | 4/2006 | Gerngross |
| 7,094,530 B1 | 8/2006 | Sasaki et al. |
| 7,105,554 B2 | 9/2006 | Orchard et al. |
| 7,122,330 B2 | 10/2006 | Emalfarb et al. |
| 7,163,804 B1 | 1/2007 | Royer et al. |
| 7,198,938 B2 | 4/2007 | Shuster et al. |
| 7,259,007 B2 | 8/2007 | Bobrowicz et al. |
| 7,303,877 B2 | 12/2007 | Connelly |
| 7,309,595 B2 | 12/2007 | Dekker et al. |
| 7,314,974 B2 | 1/2008 | Cao et al. |
| 7,323,327 B2 | 1/2008 | Edens et al. |
| 7,326,681 B2 | 2/2008 | Gemgross |
| 7,332,299 B2 | 2/2008 | Hamilton |
| 7,374,919 B2 | 5/2008 | Clausen et al. |
| 7,381,544 B2 | 6/2008 | Gilbert et al. |
| 7,429,476 B2 | 9/2008 | Clarkson et al. |
| 7,449,308 B2 | 11/2008 | Gemgross et al. |
| 7,465,577 B2 | 12/2008 | Bobrowicz |
| 7,491,510 B2 | 2/2009 | Contreras et al. |
| 7,507,573 B2 | 3/2009 | Contreras et al. |
| 7,563,607 B2 | 7/2009 | Duan et al. |
| 7,598,055 B2 | 10/2009 | Bobrowicz et al. |
| 7,625,756 B2 | 12/2009 | Hamilton |
| 7,629,163 B2 | 12/2009 | Gerngross |
| 7,629,451 B2 | 12/2009 | Clarkson et al. |
| 7,691,621 B2 | 4/2010 | Wang |
| 7,737,325 B2 | 6/2010 | Kanda et al. |
| 7,741,442 B2 | 6/2010 | Kanda et al. |
| 7,771,971 B2 | 8/2010 | Connelly |
| 7,794,974 B2 | 9/2010 | Van Peij et al. |
| 7,795,002 B2 | 9/2010 | Davidson et al. |
| 7,858,360 B2 | 12/2010 | Hansen et al. |
| 7,863,020 B2 | 1/2011 | Hamilton |
| 7,923,430 B2 | 4/2011 | Gerngross |
| 7,935,513 B2 | 5/2011 | Gerngross et al. |
| 7,968,312 B2 | 6/2011 | Sagt et al. |
| 7,977,067 B2 | 7/2011 | Power et al. |
| 7,981,660 B2 | 7/2011 | Gerngross |
| 7,993,877 B2 | 8/2011 | Urk et al. |
| 8,017,341 B2 | 9/2011 | Nikolaev et al. |
| 8,026,083 B2 | 9/2011 | Callewaert et al. |
| 8,039,595 B2 | 10/2011 | Kanda et al. |
| 8,058,053 B2 | 11/2011 | Contreras et al. |
| 8,067,551 B2 | 11/2011 | Gerngross et al. |
| 8,075,694 B2 | 12/2011 | Duan et al. |
| 8,088,598 B2 | 1/2012 | Hjort et al. |
| 8,093,016 B2 | 1/2012 | Cervin et al. |
| 8,101,185 B2 | 1/2012 | Kanda et al. |
| 8,110,195 B2 | 2/2012 | Kanda et al. |
| 8,119,171 B2 | 2/2012 | Lopez et al. |
| 8,158,760 B2 | 4/2012 | Kanda et al. |
| 8,173,409 B2 | 5/2012 | Clarkson et al. |
| 8,198,046 B2 | 6/2012 | Wang et al. |
| 8,206,949 B2 | 6/2012 | Bobrowicz et al. |
| 8,211,691 B2 | 7/2012 | Gerngross |
| 8,232,377 B2 | 7/2012 | Chiba et al. |
| 8,268,609 B2 | 9/2012 | Hamilton |
| 8,288,517 B2 | 10/2012 | Clarkson et al. |
| 8,298,811 B2 | 10/2012 | Hamilton |
| 8,299,228 B2 | 10/2012 | Hamilton |
| 8,329,448 B2 | 12/2012 | Idiris et al. |
| 8,354,268 B2 | 1/2013 | Contreras et al. |
| 8,389,269 B2 | 3/2013 | Sagt et al. |
| 8,426,164 B2 | 4/2013 | Hjort et al. |
| 8,440,456 B2 | 5/2013 | Callewaert et al. |
| 8,445,227 B2 | 5/2013 | Bobrowicz et al. |
| 8,450,098 B2 | 5/2013 | Kim et al. |
| 8,501,438 B2 | 8/2013 | Bobrowicz et al. |
| 8,507,224 B2 | 8/2013 | Choi |
| 8,518,667 B2 | 8/2013 | Wang et al. |
| 8,597,906 B2 | 12/2013 | Callewaert et al. |
| 8,633,006 B2 | 1/2014 | Otani et al. |
| 8,633,010 B2 | 1/2014 | Lehmbeck et al. |
| 8,647,856 B2 | 2/2014 | Shasky et al. |
| 8,663,971 B2 | 3/2014 | Contreras et al. |
| 8,680,252 B2 | 3/2014 | Emalfarb et al. |
| 8,697,394 B2 | 4/2014 | Bobrowicz et al. |
| 8,715,963 B2 | 5/2014 | Sethuraman et al. |
| 8,716,004 B2 | 5/2014 | Wang |
| 8,728,761 B2 | 5/2014 | Cadoret et al. |
| 8,741,633 B2 | 6/2014 | Nett et al. |
| 8,741,654 B2 | 6/2014 | Bodie |
| 8,771,989 B2 | 7/2014 | Choi |
| 8,795,984 B2 | 8/2014 | Bobrowicz et al. |
| 8,812,247 B2 | 8/2014 | Roubos |
| 8,815,544 B2 | 8/2014 | Davidson et al. |
| 8,815,580 B2 | 8/2014 | Callewaert et al. |
| 8,859,234 B2 | 10/2014 | Umana et al. |
| 8,877,462 B2 | 11/2014 | Gerngross et al. |
| 8,883,483 B2 | 11/2014 | Gerngross et al. |
| 8,916,363 B2 | 12/2014 | Gusakov et al. |
| 8,932,825 B2 | 1/2015 | Wildt et al. |
| 8,936,917 B2 | 1/2015 | Wang et al. |
| 8,936,918 B2 | 1/2015 | Bobrowicz et al. |
| 8,986,949 B2 | 3/2015 | Hamilton |
| 8,986,974 B2 | 3/2015 | Maiyuran et al. |
| 8,999,671 B2 | 4/2015 | Hamilton |
| 9,023,637 B2 | 5/2015 | Dai et al. |
| 9,102,969 B2 | 8/2015 | Nishiyama et al. |
| 9,113,649 B2 | 8/2015 | Poulsen et al. |
| 9,175,296 B2 | 11/2015 | Punt et al. |
| 9,206,408 B2 | 12/2015 | Callewaert et al. |
| 9,222,083 B2 | 12/2015 | Callewaert et al. |
| 9,255,275 B2 | 2/2016 | Shasky et al. |
| 9,273,279 B2 | 3/2016 | Wang |
| 9,359,628 B2 | 6/2016 | Contreras et al. |
| 9,365,645 B1 | 6/2016 | Bengea et al. |
| 9,399,764 B2 | 7/2016 | Natunen et al. |
| 9,493,790 B2 | 11/2016 | Yaver et al. |
| 9,567,596 B2 | 2/2017 | Landowski et al. |
| 9,587,245 B2 | 3/2017 | Bardor et al. |
| 2002/0058313 A1 | 5/2002 | Renkonan et al. |
| 2002/0068325 A1 | 6/2002 | Ng et al. |
| 2002/0132320 A1 | 9/2002 | Wang et al. |
| 2002/0137134 A1 | 9/2002 | Gerngross |
| 2003/0013173 A1 | 1/2003 | Clausen et al. |
| 2003/0115614 A1 | 6/2003 | Kanda et al. |
| 2003/0148464 A1 | 8/2003 | Hjort et al. |
| 2003/0157108 A1 | 8/2003 | Presta |
| 2003/0175884 A1 | 9/2003 | Umana et al. |
| 2003/0233675 A1 | 12/2003 | Cao et al. |
| 2004/0014170 A1 | 1/2004 | Miura et al. |
| 2004/0018573 A1 | 1/2004 | Power et al. |
| 2004/0018588 A1 | 1/2004 | Contreras et al. |
| 2004/0018590 A1 | 1/2004 | Gergross et al. |
| 2004/0072290 A1 | 4/2004 | Umana et al. |
| 2004/0093621 A1 | 5/2004 | Shitara et al. |
| 2004/0110176 A1 | 6/2004 | Fujiyama et al. |
| 2004/0115188 A1 | 6/2004 | Fernandez et al. |
| 2004/0136986 A1 | 7/2004 | Raju |
| 2004/0171826 A1 | 9/2004 | Hamilton |
| 2004/0191256 A1 | 9/2004 | Raju |
| 2004/0230042 A1 | 11/2004 | Hamilton |
| 2004/0241817 A1 | 12/2004 | Umana |

(56) References Cited

U.S. PATENT DOCUMENTS

| | | |
|---|---|---|
| 2004/0259150 A1 | 12/2004 | Nakamura et al. |
| 2005/0106664 A1 | 5/2005 | Contreras et al. |
| 2005/0170452 A1 | 8/2005 | Wildt et al. |
| 2005/0181437 A1 | 8/2005 | Clausen et al. |
| 2005/0208617 A1 | 9/2005 | Bobrowicz et al. |
| 2005/0260729 A1 | 11/2005 | Hamilton |
| 2005/0262593 A1 | 11/2005 | Kanda et al. |
| 2005/0265988 A1 | 12/2005 | Choi et al. |
| 2005/0276805 A1 | 12/2005 | Hanai et al. |
| 2005/0277154 A1 | 12/2005 | Dukler et al. |
| 2006/0000996 A1 | 1/2006 | Soldo |
| 2006/0008879 A1 | 1/2006 | Otani et al. |
| 2006/0014254 A1 | 1/2006 | Haseltine et al. |
| 2006/0024292 A1 | 2/2006 | Gerngross et al. |
| 2006/0024304 A1 | 2/2006 | Gerngross et al. |
| 2006/0029604 A1 | 2/2006 | Gerngross et al. |
| 2006/0034828 A1 | 2/2006 | Gerngross et al. |
| 2006/0034829 A1 | 2/2006 | Gerngross et al. |
| 2006/0040353 A1 | 2/2006 | Davidson et al. |
| 2006/0063254 A1 | 3/2006 | Kanda et al. |
| 2006/0160179 A1 | 7/2006 | Bobrowicz et al. |
| 2006/0211085 A1 | 9/2006 | Bobrowicz |
| 2006/0234345 A1 | 10/2006 | Schwartz et al. |
| 2006/0252096 A1 | 11/2006 | Zha et al. |
| 2006/0252672 A1 | 11/2006 | Betenbaugh et al. |
| 2006/0257399 A1 | 11/2006 | Gerngross et al. |
| 2006/0286637 A1 | 12/2006 | Hamilton |
| 2007/0037248 A1 | 2/2007 | Bobrowicz |
| 2007/0048282 A1 | 3/2007 | Rosen et al. |
| 2007/0067855 A1 | 3/2007 | Jarvis et al. |
| 2007/0105127 A1 | 5/2007 | Gerngross et al. |
| 2007/0155956 A1 | 7/2007 | Chapman et al. |
| 2007/0178551 A1 | 8/2007 | Gerngross et al. |
| 2007/0254336 A1 | 11/2007 | Nikolaev et al. |
| 2008/0026376 A1 | 1/2008 | Wang et al. |
| 2008/0085540 A1 | 4/2008 | Hamilton |
| 2008/0108105 A1 | 5/2008 | Peij et al. |
| 2008/0199942 A1 | 8/2008 | Hamilton |
| 2008/0206816 A1 | 8/2008 | Idiris et al. |
| 2008/0220473 A1 | 9/2008 | Claeyssens et al. |
| 2008/0248530 A1 | 10/2008 | Hansen et al. |
| 2008/0274498 A1 | 11/2008 | Gerngross |
| 2008/0292581 A1 | 11/2008 | Kroz et al. |
| 2008/0305525 A1 | 12/2008 | Kang et al. |
| 2009/0069232 A1 | 3/2009 | Callewaert et al. |
| 2009/0130709 A1 | 5/2009 | Hamilton |
| 2009/0136525 A1 | 5/2009 | Gerngross et al. |
| 2009/0155239 A1 | 6/2009 | Nakamura |
| 2009/0162377 A1 | 6/2009 | Gerngross et al. |
| 2009/0170159 A1 | 7/2009 | Bobrowicz et al. |
| 2009/0171070 A1 | 7/2009 | Urk et al. |
| 2009/0176219 A1 | 7/2009 | Parenicova et al. |
| 2009/0191199 A1 | 7/2009 | Kanda et al. |
| 2009/0191587 A1 | 7/2009 | Chiba et al. |
| 2009/0191592 A1 | 7/2009 | Kanda et al. |
| 2009/0221030 A1 | 9/2009 | Bao et al. |
| 2009/0226464 A1 | 9/2009 | Gerngross et al. |
| 2009/0226959 A1 | 9/2009 | Bobrowicz et al. |
| 2009/0253173 A1 | 10/2009 | Wang |
| 2009/0263863 A1 | 10/2009 | Contreras et al. |
| 2009/0275079 A1 | 11/2009 | Edens et al. |
| 2009/0286280 A1 | 11/2009 | Roubos et al. |
| 2010/0016555 A1 | 1/2010 | Bobrowicz et al. |
| 2010/0021991 A1 | 1/2010 | Gerngross |
| 2010/0028951 A1 | 2/2010 | Hamilton |
| 2010/0062485 A1 | 3/2010 | Kang et al. |
| 2010/0093030 A1 | 4/2010 | Sagt et al. |
| 2010/0137565 A1 | 6/2010 | Javaud et al. |
| 2010/0184143 A1 | 7/2010 | Gerngross et al. |
| 2010/0222267 A1 | 9/2010 | Finnis et al. |
| 2010/0267084 A1 | 10/2010 | Contreras et al. |
| 2010/0279356 A1 | 11/2010 | Hamilton |
| 2010/0311122 A1 | 12/2010 | Choi et al. |
| 2011/0020870 A1 | 1/2011 | Gerngross |
| 2011/0021378 A1 | 1/2011 | Callewaert et al. |
| 2011/0027831 A1 | 2/2011 | Hamilton |
| 2011/0039729 A1 | 2/2011 | DeLisa et al. |
| 2011/0045533 A1 | 2/2011 | Cadoret et al. |
| 2011/0052610 A1 | 3/2011 | Kanda et al. |
| 2011/0053214 A1 | 3/2011 | Davidson et al. |
| 2011/0053223 A1 | 3/2011 | Bayer et al. |
| 2011/0059115 A1 | 3/2011 | Kanda et al. |
| 2011/0076721 A1 | 3/2011 | Desai et al. |
| 2011/0111977 A1 | 5/2011 | Retallack |
| 2011/0124576 A1 | 5/2011 | Sleep et al. |
| 2011/0143396 A1 | 6/2011 | Choi |
| 2011/0165306 A1 | 7/2011 | Dekker et al. |
| 2011/0201540 A1 | 8/2011 | Callewaert et al. |
| 2011/0207214 A1 | 8/2011 | Helenius et al. |
| 2011/0283422 A1 | 11/2011 | Nelson et al. |
| 2011/0294191 A1 | 12/2011 | Wang |
| 2011/0313133 A1 | 12/2011 | Finnis et al. |
| 2011/0313137 A1 | 12/2011 | Zha |
| 2012/0003695 A1 | 1/2012 | Davidson et al. |
| 2012/0030839 A1 | 2/2012 | Emalfarb et al. |
| 2012/0059155 A1 | 3/2012 | Evans et al. |
| 2012/0064568 A1 | 3/2012 | Hamilton |
| 2012/0107856 A1 | 5/2012 | Punt et al. |
| 2012/0135461 A1 | 5/2012 | Cook et al. |
| 2012/0149064 A1 | 6/2012 | Wang et al. |
| 2012/0149873 A1 | 6/2012 | Blackwell et al. |
| 2012/0213728 A1 | 8/2012 | Meehl et al. |
| 2012/0231502 A1 | 9/2012 | Hamilton et al. |
| 2012/0232007 A1 | 9/2012 | Bobrowicz et al. |
| 2012/0276075 A1 | 11/2012 | Monod et al. |
| 2012/0288892 A1 | 11/2012 | Maiyuran et al. |
| 2012/0309935 A1 | 12/2012 | Govindappa et al. |
| 2012/0322100 A1 | 12/2012 | Gerngross |
| 2012/0328626 A1 | 12/2012 | Sethuraman et al. |
| 2013/0011875 A1 | 1/2013 | Meehl et al. |
| 2013/0018177 A1 | 1/2013 | Hamilton |
| 2013/0053550 A1 | 2/2013 | Geysens et al. |
| 2013/0071390 A1 | 3/2013 | Stadheim et al. |
| 2013/0084608 A1 | 4/2013 | Szabo et al. |
| 2013/0171692 A1 | 7/2013 | Abe et al. |
| 2013/0189733 A1 | 7/2013 | Sagt et al. |
| 2013/0195835 A1 | 8/2013 | Callewaert et al. |
| 2013/0266981 A1 | 10/2013 | Hamilton |
| 2013/0295604 A1 | 11/2013 | Gerngross |
| 2013/0295608 A1 | 11/2013 | Bobrowicz et al. |
| 2013/0330340 A1 | 12/2013 | Hamilton et al. |
| 2013/0330755 A1 | 12/2013 | Joshi et al. |
| 2014/0046032 A1 | 2/2014 | Blanche et al. |
| 2014/0086916 A1 | 3/2014 | Zha |
| 2014/0100836 A1 | 4/2014 | Aebi et al. |
| 2014/0154707 A1 | 6/2014 | Bardor et al. |
| 2014/0200180 A1 | 7/2014 | Bobrowicz et al. |
| 2014/0212977 A1 | 7/2014 | Yaver et al. |
| 2014/0227391 A1 | 8/2014 | Otani et al. |
| 2014/0234902 A1 | 8/2014 | Gerngross |
| 2014/0235537 A1 | 8/2014 | Meehl et al. |
| 2014/0271632 A1 | 9/2014 | Hossler et al. |
| 2014/0286946 A1 | 9/2014 | Stadheim et al. |
| 2014/0302028 A1 | 10/2014 | Zha |
| 2014/0302556 A1 | 10/2014 | Jiang et al. |
| 2014/0314797 A1 | 10/2014 | Sethuraman et al. |
| 2014/0329276 A1 | 11/2014 | Choi et al. |
| 2014/0345004 A1 | 11/2014 | Callewaert et al. |
| 2014/0370546 A1 | 12/2014 | Landowski et al. |
| 2015/0017686 A1 | 1/2015 | Hamilton |
| 2015/0031081 A1 | 1/2015 | Vervecken et al. |
| 2015/0051381 A1 | 2/2015 | Gerngross et al. |
| 2015/0079633 A1 | 3/2015 | Bobrowicz et al. |
| 2015/0139988 A1 | 5/2015 | Labkovsky et al. |
| 2015/0152427 A1 | 6/2015 | Wildt et al. |
| 2015/0175980 A1 | 6/2015 | Tsang et al. |
| 2015/0176044 A1 | 6/2015 | Natunen et al. |
| 2015/0203890 A1 | 7/2015 | Hamilton |
| 2015/0225761 A1 | 8/2015 | Maiyuran et al. |
| 2015/0275222 A1 | 10/2015 | Jiang et al. |
| 2015/0299690 A1 | 10/2015 | Jiang et al. |
| 2015/0337273 A1 | 11/2015 | Geysens et al. |
| 2015/0337274 A1 | 11/2015 | Chen et al. |
| 2015/0344579 A1 | 12/2015 | Thuduppathy et al. |

(56) References Cited

U.S. PATENT DOCUMENTS

| | | |
|---|---|---|
| 2015/0344585 A1 | 12/2015 | Wong et al. |
| 2015/0344587 A1 | 12/2015 | Wong et al. |
| 2015/0368334 A1 | 12/2015 | Meade et al. |
| 2015/0374795 A1 | 12/2015 | DiMarchi et al. |
| 2015/0376249 A1 | 12/2015 | Choi |
| 2016/0017343 A1 | 1/2016 | Jin et al. |
| 2016/0068880 A1 | 3/2016 | Gerngross |
| 2016/0115216 A1 | 4/2016 | Hubalek et al. |
| 2016/0115498 A1 | 4/2016 | Jarczowski et al. |
| 2016/0152702 A1 | 6/2016 | Bengea et al. |
| 2016/0153019 A1 | 6/2016 | Natunen et al. |
| 2016/0159897 A1 | 6/2016 | Zeng |
| 2016/0237466 A1 | 8/2016 | Landowski et al. |
| 2016/0244737 A1 | 8/2016 | Teramoto et al. |
| 2016/0376570 A1 | 12/2016 | Natunen et al. |
| 2017/0002337 A1 | 1/2017 | Natunen et al. |

FOREIGN PATENT DOCUMENTS

| | | | |
|---|---|---|---|
| EP | 1783223 A1 | 5/2007 | |
| WO | WO96/36718 A1 | 11/1996 | |
| WO | WO1997/012045 A1 | 4/1997 | |
| WO | WO1997/046689 A1 | 12/1997 | |
| WO | WO2000/020596 A1 | 4/2000 | |
| WO | WO2000/046375 A2 | 8/2000 | |
| WO | WO2001/079558 A1 | 10/2001 | |
| WO | WO2004/067709 A2 | 8/2004 | |
| WO | WO2005/055944 A2 | 6/2005 | |
| WO | WO2005/087922 A1 | 9/2005 | |
| WO | WO2006/026992 A1 | 3/2006 | |
| WO | WO2006/036817 A2 | 4/2006 | |
| WO | WO2008/112092 A2 | 9/2008 | |
| WO | WO2010/034708 A1 | 4/2010 | |
| WO | WO2010/036898 A1 | 4/2010 | |
| WO | WO2010/049177 A1 | 5/2010 | |
| WO | WO2011/075677 A2 | 6/2011 | |
| WO | WO2011/106389 A1 | 9/2011 | |
| WO | WO2011106389 * | 9/2011 | |
| WO | WO-2011106389 A1 * | 9/2011 | ............ C07K 14/44 |
| WO | WO2012/021883 A2 | 2/2012 | |
| WO | WO2012/027374 A2 | 3/2012 | |
| WO | WO2012/048334 A2 | 4/2012 | |
| WO | WO2013/066765 A1 | 5/2013 | |
| WO | WO2013102674 * | 7/2013 | |
| WO | WO-2013102674 A2 * | 7/2013 | ............ C12P 21/005 |
| WO | WO2014/059541 A1 | 4/2014 | |
| WO | WO2014/138983 A1 | 9/2014 | |
| WO | WO2014/182684 A2 | 11/2014 | |
| WO | WO2014/195011 A1 | 12/2014 | |
| WO | WO2015/013116 A1 | 1/2015 | |
| WO | WO2015/025055 A1 | 2/2015 | |
| WO | WO2015/054039 A1 | 4/2015 | |
| WO | WO2015/073307 A2 | 5/2015 | |
| WO | WO2015/184004 A2 | 12/2015 | |

OTHER PUBLICATIONS

Martinez, et al. Uniprot GORHO5, XP002712644 (Oct. 19, 2011).
Martinez, et al. UniProt G0RM29_HYPJQ. "RecName: Full=Leukotriene A(4) hydrolase; Short=LTA-4 hydrolase; EC=3.3.2.6;" (2011).
Martinez, et al. Uniprot GORSP8, XP002712645 (Oct. 19, 2011).
Martinez, et al. Uniprot GORVKO, XP002712646 (Oct. 19, 2011).
Martinez, et al. Uniprot GOR8TO, XP002712647 (Oct. 19, 2011).
Marui et al., "Comparison of expression and enzymatic properties of Aspergillus oryzae lysine aminopeptidases ApsA and ApsB", World Journal of Microbiology and Biotechnology, vol. 28, No. 8, pp. 2643-2650 (2012).
Maruyama et al., "Multiple Gene Disruptions by Marker Recycling with Highly Efficient Gene-Targeting Background (DeltaligD) in Aspergillus Oryzae", Biotechnol Letters, vol. 30, Issue 10, Oct. 2008, pp. 1811-1817.
Mattern et al., "Isolation and Characterization of Mutants of Aspergillus Niger Deficient in Extracellular Proteases", Molecular and General Genetics MGG, vol. 234, Issue 2, Aug. 1992, pp. 332-336.
Mattila et al., "Functional expression of *Escherichia coli* enzymes Synthesizing GDP-L-Fucose from Inherent GDP-D-mannose in *Saccharomyces cerevisiae*", Glycobiology, vol. 10, No. 10, Oct. 2000, pp. 1041-1047.
Moralejo et al., "Thaumatin Production in Aspergillus Awamori by Use of Expression Cassettes with Strong Fungal Promoters and High Gene Dosage", Applied and Environmental Microbiology, vol. 65 No. 3, Mar. 1999, pp. 1168-1174.
Moralejo et al., "Overexpression and Lack of Degradation of Thaumatin in an Aspergillopepsin A-Defective Mutant of Aspergillus Awamori Containing an Insertion in the pepA gene", Applied Microbiology and Biotechnology, vol. 54, Issue 6, Dec. 2000, pp. 772-777.
Moralejo et al., "Silencing of the Aspergillopepsin B (pepB) Gene of Aspergillus Awamori by Antisense RNA Expression or Protease Removal by Gene Disruption Results in a Large Increase in Thaumatin Production", Applied and Environmental Microbiology, vol. 68, No. 7, Jul. 2002, pp. 3550-3559.
Morya et al., "In Silico Characterization of Alkaline Proteases from Different Species of Aspergillus", Applied Biochemistry and Biotechnology, vol. 166, Issue 1, Jan. 2012, pp. 243-257.
Mouyna et al., "Members of protein O-mannosyltransferase family in Aspergillus fumigatus differentially affect growth, morphogenesis and viability", Molecular Microbiol, doi: 10.1111/j.1365-2958.2010.07164.x, vol. 76, No. 5,Jun. 2010, pp. 1205-1221.
Nakayama et al., "Interaction of GDP-4-keto-6-deoxymannose-3,5-epimerase-4-reductase with GDP-mannose-4,6-dehydratase stabilizes the enzyme activity for formation of GDP-fucose from GDP-mannose", Glycobiology. vol. 13, No. 10, Oct. 2003, pp. 673-680.
Nasab, et al. All in one: Leishmania major STT3 proteins substitute for the whole oligosaccharyltransferase complex in *Saccharomyces cerevisiae*. Mol. Biol. Cell. 19:3758-3768 (2008).
Nascimento et al., "Statistical Coupling Analysis of Aspartic Proteinases Based on Crystal Structures of the Trichoderma Reesei Enzyme and its Complex with Pepstatin A", Journal of Molecular Biology, vol. 382, Issue 3, Oct. 10, 2008, pp. 763-778.
Nemoto et al., "Isolation of Aspergillus Oryzae Mutants for Heterologous Protein Production from a Double Proteinase Gene Disruptant" Applied Microbiology and Biotechnology, vol. 82, Issue 6, Apr. 2009, pp. 1105-1114.
Nett et al., "Characterization of the Pichia pastoris protein-O-mannosyltransferase gene family", PLoS One, doi:10.1371/journal.pone.006832, vol. 8 , No. 7, pp. e68325, Jul. 1, 2013.
Oda et al., "Nucleotide Sequence of the Gene Encoding the Precursor Protein of Pepstatin Insensitive Acid Protease B, Scytalidopepsin B, from Scytalidium Lignicolum", Bioscience, Biotechnology, and Biochemistry, 62(8), Aug. 1998, pp. 1637-1639.
Oda, K. Scytalidopepsin B. Handbook of Proteolytic Enzymes, 2nd Ed. (2004).
O'Donoghue et al., "Inhibition of a Secreted Glutamic Peptidase Prevents Growth of the Fungus Talaromyces Emersonii", Journal of Biological Chemistry, vol. 283. No. 43, Oct. 24, 2008, pp. 29186-29195.
Ohashi, et al. Production of heterologous glycoproteins by a glycosylation-defective alg3och1 mutant of Schizosaccharomyces pombe. J. Biotech. 150(3): 348-356 (2010).
Oka et al., "Molecular characterization of protein O-mannosyltransferase and its involvement in cell-wall synthesis in Aspergillus nidulans", Microbiology, vol. 150, No. 6, 2004, pp. 1973-1982.
Oka et al., "Protein O-mannosyltransferase A of Aspergillus awamori is involved in O-mannosylation of glucoamylase I", Microbiology, vol. 151, No. 11, 2005, pp. 3657-3667.
Paschinger et al., "Fucosyltransferase substrate specificity and the order of fucosylation in invertebrates", Glycobiology. vol. 15, No. 5, May 2005, pp. 463-474.
Pillai et al., "Crystal Structure of Scytalidoglutamic Peptidase with its First Potent Inhibitor Provides Insights into Substrate Specificity and Catalysis", Journal of Molecular Biology, vol. 365, Issue 2, 2007, pp.343-361.

(56) References Cited

OTHER PUBLICATIONS

Pourcq et al., "Engineering of Glycosylation in Yeast and Other Fungi: Current State and Perspectives", Applied Microbiology and Biotechnology, Springer, Berlin, De, vol. 87, No. 5, Jun. 29, 2010, pp. 1617-1631.
Pozo et al., "Functional Analysis of tvsp1, a Serine Protease-Encoding Gene in the Biocontrol Agent Trichoderma Virens", Fungal Genetics and Biology, 41, 2004, pp. 336-348.
Prill et al., "PMT family of Candida albicans: five protein mannosyltransferase isoforms affect growth, morphogenesis and antifungal resistance", Molecular Microbiology, vol. 55, No. 2, Jan. 2005, pp. 546-560.
Punt et al., "Filamentous Fungi as Cell Factories for Heterologous Protein Production", Trends in Biotechnology, Elsevier Publications, Cambridge, GB, vol. 20, No. 5, May 1, 2002, pp. 200-206.
Reichard et al., "Molecular Cloning and Sequencing of the Gene Encoding an Extracellular Aspartic Proteinase from Aspergillus Fumigatus", FEMS Microbioly Letters, 130, 1995, pp. 69-74.
Reichard et al., "Molecular Cloning and Targeted Deletion of PEP2 Which Encodes a Novel Aspartic Proteinase from Aspergillus Fumigatus", Int. J. Med. Microbiol., 290, 2000, pp. 85-96.
Reichard et al., "Sedolisins, a New Class of Secreted Proteases from Aspergillus Fumigatus with Endoprotease or Tripeptidyl-Peptidase Activity at acidic pHs", Applied and Environmental Microbiology, vol. 72, No. 3, Mar. 2006, pp. 1739-1748.
Rhomberg et al., "Reconstitution in vitro of the GDP-fucose biosynthetic pathways of Caenorhabditis elegans and Drosophila melanogaster", FEBS J., vol. 273, No. 10, May 2006, pp. 2244-2256.
Roberts et al., "Heterologous Gene Expression in Aspergillus Niger: a Glucoamylase-Porcine Pancreatic Prophospholipase A2 Fusion Protein is Secreted and Processed to Yield Mature Enzyme", Gene., 122, 1992, pp. 155-161.
Rolland, et al. pH controls both transcription and post-translational processing of the protease BcACP1 in the phytopathogenic fungus Botrytis cinerea. Microbiol. 155: 2097-2105 (2009).
Rouabhia et al., "Virulence of the fungal pathogen Candida albicans requires the five isoforms of protein mannosyltransferases", Infection and Immunity, vol. 73, No. 8, Aug. 2005, pp. 4571-4580.
Sasorith, et al. Glycosylation. IMGT Lexique, pp. 1-7 (2004).
Sharma et al., "Approaches for Refining Heterologous Protein Production in Filamentous Fungi", World J Microbiol Biotechnol, 25, 2009, pp. 2083-2094.
Sharon et al., "Transcription Factor PrtT Controls Expression of Multiple Secreted Proteases in the Human Pathogenic Mold Aspergillus Fumigatus", Infection and Immunity, vol. 77, No. 9, Sep. 2009, pp. 4051-4060.
Simkovic et al., "Induction of Secretion of Extracellular Proteases from Trichoderma Viride", Acta Chimica Slovaca, vol. 1, No. 1, 2008, pp. 250-264.
Sims et al., "Glutamic Protease Distribution is Limited to Filamentous Fungi", FEMS Microbiology Letters, 239, 2004, pp. 95-101.
Sriranganadane et al., "Secreted Glutamic Protease Rescues Aspartic Protease Pep Deficiency in Aspergillus Fumigatus During Growth in Acidic Protein Medium", Microbiology, 157, 2011, pp. 1541-1550.
Strahl-Bolsinger et al., "PMT1, the gene for a key enzyme of protein O-glycosylation in Saccharomyces cerevisiae", Proceedings of the National Academy of Sciences USA, vol. 90, No. 17, Sep. 1, 1993, pp. 8164-8168.
Suárez et al., "Characterization of Genes Encoding Novel Peptidases in the Biocontrol Fungus Trichoderma Harzianum CECT 2413 Using the TrichoEST Functional Genomics Approach", Curr Genet, 51, 2007, pp. 331-342.
Suarez, et al. UniProt A4V8W6 (2007).
Takahashi, K Aspergillopepsin II. Handbook of Proteolytic Enzymes, 2nd Ed. (2004).
Timpel et al., "Multiple functions of Pmt1p-mediated protein O-mannosylation in the fungal pathogen Candida albicans", Journal of Biological Chemistry, vol. 273, No. 33, Aug. 14, 1998, pp. 20837-20846.
Tonetti et al., "Synthesis of GDP-L-fucose by the Human FX Protein", J Biol Chem. Nov. 1996, vol. 271, No. 14, pp. 27274-27279.
Uozumi et al., "Purification and cDNA cloning of porcine brain GDP-L-Fuc:N-acetyl-beta-D-glucosaminide alpha1->6fucosyltransferase", J Biol Chem. vol. 271, No. 44, Nov. 1, 1996, pp. 27810-27817.
Uusitalo et al., Enzyme Production by Recombinant Trichoderma Reesei Strains. Journal of Biotechnology, 17, 1991, pp. 35-50.
Van Den Hombergh et al., "New Protease Mutants in Aspergillus Niger Result in Strongly Reduced in Vitro Degradation of Target Proteins; Genetical and Biochemical Characterization of Seven Complementation Groups", Curr Genet, 28, 1995, pp. 299-308.
Van Den Hombergh et al., "Improve the Efficiency of Protein Expression in Fungi", Chemtech 26, Feb. 1996, pp. 30-37.
Van Den Hombergh et al., "Aspergillus as a Host for Heterologous Protein Production: The Problem of Proteases", Tibtech, vol. 15, Jul. 1997, pp. 256-263.
Van Den Hombergh et al., "Production of the Homologous Pectin Lyase B Protein in Six Genetically Defined Protease-Deficient Aspergillus Niger Mutant Strains", Cliff Genet, vol. 32, Jul. 1997, pp. 73-81.
Van Den Hombergh, et al. Disruption of three acid proteases in Aspergillus niger. Eur. J. Biochem. 247: 605-613 (1997).
Van Kuyk et al., "Analysis of Two Aspergillus Nidulans Genes Encoding Extracellular Proteases", Fungal Genetics and Biology, vol. 29, Apr. 2000, pp. 201-210.
Vázquez-Laslop et al., "Characterization of a Vacuolar Protease in Neurospora Crassa and the Use of Gene Riping to Generate Protease-Deficient Strains", The Journal of Biological Chemistry, vol. 271, No. 36, Sep. 1996, pp. 21944-21949.
Vinterová et al., "Evidence for the Presence of Proteolytically Active Secreted Aspartic Proteinase of Candida Parapsilosis in the Cell Wall", Protein Science, vol. 20, Dec. 2011, pp. 2004-2012.
Viterbo, et al. UniProt Q64HW0 (2004).
Wang et al., "Isolation of Four Pepsin-Like Protease Genes from Aspergillus Niger and Analysis of the Effect of Disruptions on Heterologous Laccase Expression", Fungal Genetics and Biology, vol. 45, Jan. 2008, pp. 17-27.
Wang et al., "Modification of epidermal growth factor-like repeats with O-fucose. Molecular cloning and expression of a novel GDP-fucose protein O-fucosyltransferase", J Biol Chem., vol. 276, No. 43, Oct. 26, 2001, pp. 40338-40345.
Wang et al., "Bioprocessing Strategies to Improve Heterologous Protein Production in Filamentous Fungal Fermentations", Biotechnology Advances, vol. 23, Mar. 2005, pp. 115-129.
Ward, et al. Production of recombinant proteins by filamentous fungi. Biotechnol. Adv. 30(5): 1119-1139 (2012).
Weber et al., "Pmt-mediated O mannosylation stabilizes an essential component of the secretory apparatus, Sec20p, in Candida albicans", Eukaryotic Cell, vol. 3, No. 5, Oct. 2004, pp. 1164-1168.
Wildt et al., "The humanization of N-glycosylation Pathways in Yeast", Nature reviews, Microbiology, vol. 3, No. 2, Feb. 2005, pp. 119-128.
Willger et al., "Characterization of the PMT gene family in Cryptococcus neoformans", PLoS One, doi:10.1371/journal.pone.0006321 vol. 4, No. 7, Jul. 27, 2009, pp. e6321.
Xu et al., "Increased Heterologous Protein Production in Aspergillus Niger Fermentation through Extracellular Proteases Inhibition by Pelleted Growth", Biotechnol Prog., vol. 16, No. 2, Mar.-Apr. 2000, pp. 222-227.
Yabuki, et al. Identification of a glutamine residue essential for catalytic activity of asperfilloglutamic peptidase by site-directed mutagenesis. FEBS Letter, 569: 161-4 (2004).
Yan et al., "Cloning and Heterologous Expression of SS10, a Subtilisin-Like Protease Displaying Antifungal Activity from Trichoderma Harzianum", FEMS Microbiology Letters, vol. 290, Jan. 2009, pp. 54-61.
Yoon, et al. Construction of quintuple protease gene disruptant for heterologous protein production in aspergillus oryzae. Appl. Microbiol. Biotechnol. 82: 691-701 (2009).

(56) References Cited

OTHER PUBLICATIONS

Yoon, et al. Disruption of ten protease genes in the filamentous fungus aspergillus oryzae highly improves production of heterologous proteins. Appl. Microbiol. Biotechnol. 89: 747-759 (2010).
Zakrzewska et al., "cDNA encoding protein O-mannosyltransferase from the filamentous fungus Trichoderma reesei; functional equivalence to *Saccharomyces cerevisiae* PMT2", Current Genetics, vol. 43, May 2003, pp. 11-16.
Zhu et al., "Improved Heterologous Protein Production by a Tripeptidyl Peptidase Gene (Aosedd) Disruptant of the Filamentous Fungus Aspergillus Oryzae", The Journal of General and Applied Microbiology, vol. 58, 2012, pp. 199-209.
Zhu et al., "Further Enhanced Production of Heterologous Proteins by Double-Gene Disruption (ΔAosedD ΔAovps10) in a Hyper-Producing Mutant of Aspergillus Oryzae", Applied Microbiology and Biotechnology, vol. 97, 2013, pp. 6347-6357.
Zufferey, et al. STT3, a highly conserved protein required for yeast oligosaccharyl transferase activity in vivo. EMBO J. 14:4949-4960 (1995).
International Search Report for PCT/EP2011/070956 dated Nov. 14, 2012, 8 pages.
International Search Report for PCT/EP2013/060627 dated Jul. 26, 2013, 4 pages.
International Search Report for PCT/EP2014/064818 dated Dec. 15, 2014, 9 pages.
International Search Report for PCT/EP2013/050126 dated Sep. 24, 2013.
International Search Report for PCT/EP2014/064248 dated Sep. 8, 2014.
International Search Report for PCT/EP2014/064820 dated Jan. 15, 2015.
Baïet et al. "N-glycans of Phaeodactylum tricornutum diatom and functional characterization of its N-acetylglucosaminyltransferase I enzyme", J Biol Chem. Feb. 25, 2011;286(8):6152-64.
Banerjee et al. "The evolution of N-glycan-dependent endoplasmic reticulum quality control factors for glycoprotein folding and degradation", Proc Natl Acad Sci U S A. Jul. 10, 2007;104(28)11676-81.
Burda et al. "Ordered assembly of the asymmetrically branched lipid-linked oligosaccharide in the endoplasmic reticulum is ensured by the substrate specificity of the individual glycosyltransferases", Glycobiology. Jun. 1999;9(6):617-25.
De Pourcq et al. "Engineering Yarrowia lipolytica to produce glycoproteins homogeneously modified with the universal Man3GlcNAc2 N-glycan core", PLoS One. 2012;7(6):e39976.
Geysens et al. "Cloning and characterization of the glucosidase II alpha subunit gene of Trichoderma reesei: a frameshift mutation results in the aberrant glycosylation profile of the hypercellulolytic strain Rut-C30", Appl Environ Microbiol. Jun. 2005;71(6):2910-24.
Jones et al. "Deletion of the glucosidase II gene in Trypanosoma brucei reveals novel N-glycosylation mechanisms in be biosynthesis of variant surface glycoprotein", J Biol Chem. Oct. 28, 2005;280(43):35929-42.
Knauer et al. "The N-oligosaccharyltransferase complex from yeast", FEBS Lett. May 9, 1994;344(1):83-6.
Knauer et al. "The oligosaccharyltransferase complex from yeast", Biochim Biophys Acta. Jan. 6, 1999;1426(2)259-73.
Stals et al. "Identification of a gene coding for a deglycosylating enzyme in Hypocrea jecorina", FEMS Microbiol Lett. Feb. 2010;303(1):9-17.
Stals et al. "High resolution crystal structure of the endo-N-Acetyl-β-D-glucosaminidase responsible for the deglycosylation of Hypocrea jecorina cellulases", PLoS One. 2012;7(7):e40854.
Baroncelli et al. Uniprot A0A0F9XHP8 (Jul. 22, 2015).
Baroncelli et al. Uniprot A0A0G0A0X5 (Jul. 22, 2015).
Baroncelli et al. Uniprot A0A0W7VAU6 (Mar. 16, 2016).
Baroncelli et al. Uniprot A0A0W7VIN0 (Mar. 16, 2016).
Baroncelli et al. Uniprot A0A0W7W3Y0 (Mar. 16, 2016).

Belen et al. "Characterization of genes encoding novel peptidases in the biocontrol fungus Trichoderma harzianum CECT 2413 using the TrichoEST functional genomics approach", Curr Genet (2007) 51:331-342.
Hombergh et al. "Aspergillus as a host for heterologous protein production: the problem of proteases", TIBTECH, vol. 15, Jul. 1997.
Druzhinina et al. "Novel traits of Trichoderma predicted through the analysis of its secretome", FEMS Microbiol Lett, 337 (2012), 1-9.
Martinez, et al. "Genome sequencing and analysis of the biomass-degrading fungus Trichoderma reesei (syn. *Hypocrea jecorina*)." Nature Biotech. 26(5): 553-560, (Presentation Format) (2008).
Hayashi et al., "Molecular Cloning of Mouse Alpha-1,6-fucosyltransferase and Expression of its mRNA in the Developing Cerebrum", DNA Seq. vol. 11, No. (1-2), 2000, pp. 91-96.
Hese, et al. The yeast oligosaccharyltransferase complex can be replaced by STT3 from Leishmania major. Glycobiology. 19:160-171 (2009).
Hintz, J. Improved Gene Expression in Aspergillus nidulans. Can. J. Botany, 73: 876-884 (1995).
Huang et al., "Identification of a Glutamic Acid and an Aspartic Acid Residue Essential for Catalytic Activity of Aspergillopepsin II, a non-pepsin type Acid Proteinase", The Journal of Biological Chemistry, vol. 275, No. 34, Aug. 25, 2000, pp. 26607-26614.
Idiris, et al. Enhanced productivity of protease-sensitive heterologous proteins by disruption of multiple protease genes in the fission yeast *Schizosaccharomyces pombe*. Appl. Microbiol. Biotech. 73: 404-420 (2006).
Idiris, et al. Enhanced protein secretion from multiprotease-deficient fission yeast by modification of its vacuolar protein sorting pathway. Appl. Microbiol. Biotechnol. 85: 667-677 (2010).
Idiris, et al. Construction of a protease-deficient strain set for the fission yeast *Schizosaccharomyces pombe*, useful for effective production of protease-sensitive heterologous proteins. Yeast, 23(1): 83-99 (2006).
Inoue et al., "The Gene and Deduced Protein Sequences of the Zymogen of Aspergillus Niger acid Proteinase A", The Journal of Biological Chemistry, vol. 266, No. 29, Oct. 15, 1991, pp. 19484-19489.
Izquierdo, et al. The lipid-linked oligosaccharide donor specificities of Trypanosoma brucei oligosaccharyltransferases. Glycobiology. 22:696-703 (2012).
Janas, "Production of Extracellular Enzymes by Low-protease Mutants of Trichoderma reesei", Technologia Alimentaria, Issue 2(2), 2003, pp. 103-114.
Jarai et al., "Cloning and Characterization of the pepE Gene of Aspergillus Niger Encoding a new Aspartic Protease and Regulation of pepE and pepC", Gene., 145(2), Aug. 1994, pp. 171-178.
Jarvinen et al., "Cloning and expression of Helicobacter pylori GDP-L-fucose synthesizing enzymes (GMD and GMER) in *Saccharomyces cerevisiae*", Eur. J. Biochem, vol. 268, No. 24, Dec. 2001, pp. 6458-6464.
Jin et al., "Double Disruption of the Proteinase Genes, tppA and pepE, Increases the Production Level of Human Lysozyme by Aspergillus Oryzae", Applied Microbiology and Biotechnology, vol. 76, Issue 5, Oct. 2007, pp. 1059-1068.
Kainz, et al. N-Glycan Modification in *Aspergillus* Species. App. Env. Micro. 74(4): 1076-1086 (2008).
Kakimori et al., "Nucleotide Sequence of the Gene Encoding Pepstatin-insensitive Acid Protease B, Scytalidopepsin B, of Scytalidium Lignicolum", Bioscience Biotechnology and Biochemistry, 60(7), 1996, pp. 1210-1211.
Kataoka et al., "Catalytic residues and substrate specificity of scytalidoglutamic peptidase, the first member of the eqolisin in family (G1) of peptidases", FEBS Letters, 579(14), Jun. 6, 2005, pp. 2991-2994.
Kelleher, et al. Dolichol-linked oligosaccharide selection by the oligosaccharyltransferase in protist and fungal organisms. J. Cell. Biol. 177:29-37 (2007).
Kimura et al., "Monitoring Global Gene Expression of Proteases and Improvement of Human Lysozyme Production in the nptB gene disruptant of Aspergillus oryzae" Bioscience, Biotechnology, and Biochemistry, vol. 72, Issue 2, Feb. 2008, pp. 499-505.

(56) References Cited

OTHER PUBLICATIONS

Kriangkripipat, et al., "Aspergillus nidulans protein O-mannosyltransferases play roles in cell wall integrity and developmental patterning. Eukaryot Cell.", American Society for Microbiology, doi:10.1128/EC.00040-09, vol. 8, No. 10, Oct. 2009, pp. 1475-1485.
Kruszewska, "Heterologous expression of genes in filamentous fungi", Acta Biochimica Polonica, vol. 46, No. 1, 1999, 181-195.
Kruszewska et al., "Alterations in protein secretion caused by metabolic engineering of glycosylation pathways in fungi", Acta Biochimica Polonica, vol. 55, No. 3, 2008, pp. 447-456.
Krysan, et al. Yapsins are a family of aspartyl proteases required for cell wall integrity in Saccharomyces cerevisiae. Eukaryotic Cell. 4(8): 1364-1374 (2005).
Kubicek, et al. Comparative genome sequence analysis underscores mycoparasitism as the ancestral life style of Trichoderma. Genome Biol. 12:R40.1-R40.15 (2011).
Kubicek, et al. UniProt G9ML58 (2012).
Kubicek, et al. UniProt G9MS93 (2012).
Kubicek, et al. Uniprot G9MUE5, XP_013956131 (Feb. 22, 2012).
Kubicek, et al. UniProt G9MY25 (2012).
Kubicek, et al. Uniprot G9NC88, XP_013949516 (Feb. 22, 2012).
Kubicek, et al. UniProt G9NLJ5 (2012).
Kubicek, et al. Uniprot G9NQ54, XP_013945396 (Feb. 22, 2012).
Kubicek, et al. UniProt G9NTY0 (2012).
Kubicek, et al. UniProt G9P169 (2012).
Kubicek, et al. Uniprot G9P711, XP_013939835 (Feb. 22, 2012).
Kuriyan, et al. The origin of protein interactions and allostery in colocalization. Nature, 450: 983-90 (2007).
Kuroda, et al. Antibody expression in protease-deficient strains of the methlotrophic yeast Ogataea minuta. FEMS Yeast Res. 7: 1307-1316 (2007).
Kuroda et al., "Efficient antibody production upon suppression of O mannosylation in the yeast Ogataea minuta", Applied and Environmental Microbiology, vol. 74, No. 2, Jan. 2008, pp. 446-453.
Lengeler et al., "Protein-O-mannosyltransferases in virulence and development", Cellular and Molecular Life Sciences, vol. 65, No. 4, Mar. 2008, pp. 528-544.
Liu et al., "A new Serine Protease Gene from Trichoderma Harzianum is Expressed in Saccharomyces cerevisiae", Prikl Biokhim Mikrobiol., 45(1), Jan.-Feb. 2009, pp. 28-32.
Long, et al. UniProt I2EC22 (2012).
Lu et al., "Molecular Cloning of a cDNA for Proctase B from Aspergillus Niger Var. Macrosporus and Sequence Comparison with Other Aspergillopepsins I", Bioscience, Biotechnology, and Biochemistry, 59(5), 1995, pp. 954-955.
Lubertozzi et al., "Developing Aspergillus as a Host for Heterologous Expression", Biotechnology Advances, 27(1), Jan.-Feb. 2009, pp. 53-75.
Lussier et al., "Protein O-glycosylation in yeast. The PMT2 gene specifies a second protein O-mannosyltransferase that functions in addition to the PMT1-encoded activity", The Journal of Biological Chemistry, vol. 270, No. 6, Feb. 10, 1995, pp. 2770-2775.
Ma et al., "Fucosylation in Prokaryotes and Eukaryotes", Glycobiology, vol. 16, No. 12, Dec. 2006, pp. 158R-184R.
Maita et al., "Complete Amino Acid Sequence of Scytalidium Lignicolum Acid Protease B", Journal of Biochemistry, 95(2), Feb. 1984, pp. 465-475.
Mäntylä et al., "Industrial mutants and recombinant strains of Trichoderma reesei", In: Trichoderma and Gliocladium, vol. 2, 1998, pp. 291-309.
Margolles-Clark et al., "Improved Production of Trichoderma Harzianum Endochitinase by Expression in Trichoderma Reesei", Applied and Environmental Microbiology, vol. 2, No. 6, Jun. 1996, pp. 2145-2151.
Martinez, et al. "Genome sequencing and analysis of the biomass-degrading fungus Trichoderma reesei (syn. Hypocrea jecorina)", Nature Biotech. 26(5): 553-560 (2008).
Martinez, et al. Uniprot G0R9K1, XP_006961397 (Oct. 19, 2011).
Martinez, et al. Uniprot GORG34, XP002712642 (Oct. 19, 2011).
Martinez, et al. Uniprot GORIW3, XP002712643 (Oct. 19, 2011).
Adav et al., "Proteomic Analysis of pH and Strains Dependent Protein Secretion of Trichoderma Reesei", J Proteome Res., (10)10, Oct. 7, 2011, pp. 4579-4596.
Agaphonov et al., "Mutation of the protein-O-mannosyltransferase enhances secretion of the human urokinase-type plasminogen activator in Hansenula polymorpha", Yeast, vol. 22, No. 13, Oct. 2005, pp. 1037-1047.
Ahamed, et al. Chymostatin can combine with pepstatin to eliminate extracellular protease activity in cultures of Aspergillus niger NRRL-3. J. Ind. Microbiol. Biotechnol. 34: 165-169 (2007).
Archer et al., "Proteolytic Degradation of Heterologous Proteins Expressed in Aspergillus Niger", Biotechnology Letters, vol. 14, Issue 5, May 5, 1992, pp. 357-362.
Baldwin, et al. Develop Systems for Manufacturing 1000,000,000 Doses of an Emergency Pharmaceutical (e.g. Vaccine or Monoclonal Antibody) Within 2 Months of Product Identification. Contract No. W911NF-05-C-0072 by the Defense Advanced Research Projects Agency (DARPA). Jun. 6, 2006.
Becker et al., "Fucose: biosynthesis and biological function in mammals", Glycobiology. vol. 13 No. 7, Jul. 2003, pp. 41R-53R.
Behnsen et al., "Secreted Aspergillus Fumigatus Protease Alp1 Degrades Human Complement Proteins C3, C4, and C5", Infect Immun., 78(8), Aug. 2010, pp. 3585-3594.
Berka et al., "Molecular Cloning and Deletion of the Gene Encoding Aspergillopepsin a from Aspergillus Awamori", Gene., 86(2), Feb. 14, 1990, pp. 153-162.
Bobrowicz, et al. Engineering of an artificial glycosylation pathway blocked in core oligosaccharide assembly in the yeast Pichia pastoris: production of complex humanized glycoproteins with terminal galactose. Glycobiology, 14(9): 757-766 (2004).
Bourdineaud et al., "Pmt1 mannosyl transferase is involved in cell wall incorporation of several proteins in Saccharomyces cerevisiae", Molecular Microbiology, vol. 27, No. 1, 1998, pp. 85-98.
Breton et al., "Conserved structural features in eukaryotic and prokaryotic fucosyltransferases", Glycobiology, vol. 8, No. 1, Jan. 1998, pp. 87-94.
Broekhuijsen et al., "Secretion of Heterologous Proteins by Aspergillus Niger: Production of Active Human Interleukin-6 in a Protease-Deficient Mutant by KEX2-like Processing of a Glucoamylase-hIL6 Fusion Protein", Journal of Biotechnology, 31(2), Nov. 1993, pp. 135-145.
Cantero and Ernst, "Damage to the glycoshield activates PMT-directed O-mannosylation via the Msb2-Cek1 pathway in Candida albicans", Molecular Microbiology, vol. 80, No. 3, May 2011, pp. 715-725. doi: 10.1111/j.1365-2958.2011.07604.x.
Castro, et al. Preferential transfer of the complete glycan is determined by the oligosaccharyltransferase complex and not by the catalytic subunit. Proc. Natl. Acad. Sci. USA. 103:14756-14760 (2006).
Chigira et al., "Engineering of a mammalian O-glycosylation Pathway in the Yeast Saccharomyces cerevisiae: production of O-fucosylated epidermal growth factor domains", Glycobiology, Apr. 2008, vol. 18, No. 4, pp. 303-314.
Choi, et al. Use of combinatorial genetic libraries to humanize N-linked glycosylation in the yeast Pichia pastoris. PNAS USA, 100: 5022-27 (2003).
Choi et al. Improvement of glycan site occupancy of therapeutic glycoproteins produced in Pichia pastoris. Appl. Microbiol. Biotechnol. 95(3): 671-682 (2012).
Clarke et al., "Expression of human alpha-I-fucosyltransferase gene homologs in monkey kidney COS cells and modification of potential fucosyltransferase acceptor substrates by an endogenous glycosidase", Glycobiology. vol. 9, No. 2, Feb. 1999, pp. 191-202.
Dal Degan et al., "Purification and Characterization of two Serine Carboxypeptidases from Aspergillus Niger and their use in C-terminal Sequencing of Proteins and Peptide Synthesis", Applied and Environment Microbiology, 58(7), Jul. 1992, pp. 2144-2152.
Delgado-Jarana et al., "Overproduction of Beta-1,6-glucanase in Trichoderma Harzianum is Controlled by Extracellular Acidic Proteases and pH", Biochimca et Biophysica Acta, 1481(2), Sep. 29, 2000, pp. 289-296.

(56) References Cited

OTHER PUBLICATIONS

Delgado-Jarana et al., "Aspartyl Protease from Trichoderma Harzianum CECT 2413: Cloning and Characterization" Microbiology, 148(Pt 5), May 2002, pp. 1305-1315.
De Pourcq, et al. Engineering of glycosylation in yeast and other fungi: current state and perspectives. App. Micro. Biotech. 87(5) 1617-1631 (2010).
Diener et al., "Characterization of the Protein Processing and Secretion Pathways in a Comprehensive Set of Expressed Sequence Tags from Trichoderma reesei", FEMS Microbiology Letters, 230(2), Jan. 30, 2004, pp. 275-282.
Dienes et al., "Identification of a trypsin-like Serine Protease from Trichoderma reesei QM9414", Enzyme and Microbial Technology, vol. 40, Issue 5, Apr. 3, 2007, pp. 1087-1094.
Druzhinina, et al. Novel traits of Trichoderma predicted through the analysis of its secretome. FEMS Microbiol. Lett. 337(1): 1-9 (2012).
Durand-Poussereau et al., "Characterization of a Protease Deficient Strain of Penicillium Roqueforti Generated by Heterologous Plasmid Integration: Potential use for Protein Production", Journal of Biotechnology, 51(1), Oct. 18, 1996, pp. 97-105.
Ecker et al., "O-mannosylation precedes and potentially controls the N-glycosylation of a yeast cell wall glycoprotein", EMBO Reports, vol. 4, No. 6, Jul. 2003, pp. 628-632.
Edens et al.,"Extracellular Prolyl Endoprotease from Aspergillus Niger and its use in the Debittering of Protein Hydrolysates", Journal of Agricultural and Food Chemistry, 53(20), Oct. 5, 2005, pp. 7950-7957.
Eneyskaya et al., "Acid protease from Trichoderma reesei: Limited Proteolysis of Fungal Carbohydrases", Applied Microbiology and Biotechnology, vol. 52, Issue 52, Aug. 1999, pp. 226-231.
Foreman et al., "Transcriptional Regulation of Biomass-degrading Enzymes in the Filamentous Fungus *Trichoderma reesei*", Journal of Biological Chemistry, vol. 278, No. 34, Aug. 22, 2003, pp. 31988-31997.
Frenken et al., "Recent Advances in the Large-scale Production of Antibody Fragments using Lower Eukaryotic Microorganisms", Research in Immunology, vol. 149, Issue 6, Jul. 1998, pp. 589-599.
Frederick et al., "Cloning and characterisation of pepC, a gene encoding a serine protease from Aspergillus niger", Gene. 125, pp. 57-64 (1993).
Fujinaga et al., "The Molecular Structure and Catalytic Mechanism of a Novel Carboxyl Peptidase from Scytalidium Lignicolum", Proc Natl Acad Sci U S A, vol. 101, No. 10, Mar. 9, 2004, pp. 3364-3369.
Gagnon-Arsenault et al., "Fungal Yapsins and Cell Wall: a Unique Family of Aspartic Peptidases for a Distinctive Cellular Function", FEMS Yeast Research, 6(7), Nov. 2006, pp. 966-978.
Gentzsch et al., "The PMT gene family: protein O-glycosylation in *Saccharomyces cerevisiae* is vital", The EMBO Journal, vol. 15, No. 21, Nov. 1, 1996, pp. 5752-5759.
Gentzsch et al., "Protein-O-glycosylation in yeast: protein-specific mannosyltransferases", Glycobiology, vol. 7, No. 4, 1997, pp. 481-486.
Górka-Niec et al., "Protein glycosylation in pmt mutants of *Saccharomyces cerevisiae*. Influence of heterologously expressed cellobiohydrolase II of Trichoderma reesei and elevated levels of GDP-mannose and cis-prenyltransferase activity", Biochim Biophys Acta, vol. 1770, No. 5, 2007, pp. 774-780.
Górka-Niec et al., "Disruption of Trichoderma reesei gene encoding protein O-mannosyltransferase I results in a decrease of the enzyme activity and alteration of cell wall composition", Acta Biochim, vol. 55, No. 2, 2008, pp. 251-259.
Górka-Niec et al., "Integration of additional Trichoderma reesei gene encoding protein O-mannosyltransferase I results in a decrease of the enzyme activity and alteration of cell wall composition", Fungal Biol, vol. 115, 2011, pp. 124-132. doi: 10.1016/j.funbio.2010.11.001.

Goto et al., "Functional analysis of O-linked oligosaccharides in threonine/serine-rich region of Aspergillus glucoamylase by expression in mannosyltransferase-disruptants of yeast", Eur J Biochem, vol. 260, No. 3, Mar. 1999, pp. 596-602.
Goto et al., "Protein O-glycosylation in fungi: diverse structures and multiple functions", Biosci Biotechnol Biochem, vol. 71, No. 6, 2007, pp. 1415-1427.
Goto et al., "Protein O-mannosyltransferases B and C support hyphal development and differentiation in Aspergillus nidulans", Eukaryot Cell., American Society for Microbiology,doi:10.1128/EC.00371-08, vol. 8, No. 10, Oct. 2009, pp. 1465-1474.
Gouka et al., "Efficient Production of Secreted Proteins by Aspergillus: Progress, Limitations and Prospects", Applied Microbiology and Biotechnology, vol. 47, Issue 1, Jan. 1997, pp. 1-11.
Haab et al., "Formation of the Extracellular Proteases from Trichoderma reesei QM 9414 Involved in Cellulase Degradation", Journal of Biotechnology, vol. 16, Issue 3-4, Nov. 1990, pp. 187-198.
Hagspiel et al., "Protease Activity and Proteolytic Modification of cellulases from a Trichoderma reesei QM 9414 selectant", Applied Microbiology and Biotechnology, vol. 32, Issue 1, Nov. 1989, pp. 61-67.
Hamilton et al., "Production of complex human glycoproteins in yeast", Science, vol. 301, No. 5637, Aug. 29, 2003, pp. 1244-1246.
Hamilton et al., "Humanization of Yeast to Produce Complex Terminally Sialylated Glycoproteins", Science, vol. 313 No. 5792, Sep. 8, 2006, pp. 1441-1443.
Hamilton, et al. Glycosylation engineering in yeast: the advent of fully humanized yeast. Curr. Op. Biotech. 18(5): 387-392 (2007).
Harada, et al. Eukaryotic oligosaccharyltransferase generates free oligosaccharides during N-glycosylation. J Biol Chem. 288:32673-32684 (2013).
Hassinen, et al. Golgi N-Glycosyltransferases Form Both Homo- and Heterodimeric Enzyme Complexes in Live Cells. J. Biol. Chem., 285: 17771-77 (2010).
Berends, et al. Identification of alg3 in the mushroom-forming fungus *Schizophyllum commune* and analysis of the Δalg3 knockout mutant. Glycobiology. Feb. 2013;23(2):147-54.
Cipollo, et al. The accumulation of Man(6)GlcNAc(2)-PP-dolichol in the *Saccharomyces cerevisiae* Deltaalg9 mutant reveals a regulatory role for the Alg3p alpha1,3-Man middle-arm addition in downstream oligosaccharide-lipid and glycoprotein glycan processing. J Biol Chem. Feb. 11, 2000;275(6):4267-77.
Cueva, et al. Preferential transfer to truncated oligosaccharides to the first sequon of yeast exoglucanase in *Saccharomyces cerevisiae* alg3 cells. Biochim Biophys Acta. Apr. 17, 1996;1289(3):336-42.
Dai, et al. Impact of alg3 gene deletion on growth, development, pigment production, protein secretion, and functions of recombinant Trichoderma reesei cellobiohydrolases in Aspergillus niger. Fungal Genet Biol. Dec. 2013;61:120-32.
Davidson, et al.. Functional analysis of the ALG3 gene encoding the Dol-P-Man: Man5GlcNAc2-PP-Dol mannosyltransferase enzyme of P. pastoris. Glycobiology. May 2004;14(5):399-407.
Huffaker, et al. Yeast mutants deficient in protein glycosylation. Proc Natl Acad Sci U S A. Dec. 1983;80(24):7466-70.
Nakanishi-Shindo, et al. Structure of the N-linked oligosaccharides that show the complete loss of alpha-1,6-polymannose outer chain from och1, och1 mnn1, and och1 mnn1 alg3 mutants of *Saccharomyces cerevisiae*. J Biol Chem. Dec. 15, 1993;268(35):26338-45.
Oh, et al. Glycoengineering of the methylotrophic yeast *Hansenula polymorpha* for the production of glycoproteins with trimannosyl core N-glycan by blocking core oligosaccharide assembly. Biotechnol J. May 2008;3(5):659-68.
Verostek, et al. Glycoprotein biosynthesis in the alg3 *Saccharomyces cerevisiae* mutant. I. Role of glucose in the initial glycosylation of invertase in the endoplasmic reticulum. J Biol Chem. Jun. 5, 1993;268(16):12095-103.
Verostek, et al. Glycoprotein biosynthesis in the alg3 *Saccharomyces cerevisiae* mutant. II. Structure of novel Man6-10GlcNAc2 processing intermediates on secreted invertase. J Biol Chem. Jun. 5, 1993;268(16):12104-15.

(56) References Cited

OTHER PUBLICATIONS

Verostek, et al. Structure of *Saccharomyces cerevisiae* alg3, sec18 mutant oligosaccharides. J Biol Chem. Mar. 25, 1991;266(9):5547-51.

* cited by examiner

| Composition | Short | m\z [M+Na]+ | Structures in alg3 deletion strains | Structures in traditional pathway |
|---|---|---|---|---|
| Hex3HexNAc2 | Man3 | 933.31 | | |
| Hex4HexNAc2 | Man4 | 1095.37 | | |
| Hex3HexNAc3 | GnMan3 | 1136.40 | | |
| Hex5HexNAc2 | Man5 | 1257.42 | | |
| Hex3HexNAc3dHex | FGnMan3 | 1282.45 | | |
| Hex3HexNAc4 | G0 | 1339.48 | | |
| Hex6HexNAc2 | Hex6 / Man6 | 1419.48 | | |
| Hex3HexNAc4dHex | FG0 | 1485.53 | | |
| Hex7HexNAc2 | Hex7 / Man7 | 1581.53 | | |
| Hex4HexNAc4 | G1 | 1501.53 | | |
| Hex4HexNAc4dHex | FG1 | 1647.59 | | |
| Hex5HexNAc4 | G2 | 1663.58 | | |
| Hex5HexNAc4dHex | FG2 | 1809.64 | | |

Figure 1

PRODUCTION OF GLYCOPROTEINS WITH MAMMALIAN-LIKE N-GLYCANS IN FILAMENTOUS FUNGI

RELATED APPLICATIONS

This application was filed under 35 U.S.C. § 371 and claims priority to International Application No. PCT/EP2015/066686 filed Jul. 21, 2015, and claims priority to EP 14177875.3 filed Jul. 21, 2014, which are hereby incorporated by reference into this disclosure in their entirety.

FIELD OF THE INVENTION

The present disclosure relates to compositions, including filamentous fungal cells, such as Trichoderma fungal cells, expressing glycoproteins with mammalian-like N-glycans.

BACKGROUND

Posttranslational modification of eukaryotic proteins, particularly therapeutic proteins such as immunoglobulins, is often necessary for proper protein folding and function. Because standard prokaryotic expression systems lack the proper machinery necessary for such modifications, alternative expression systems have to be used in production of these therapeutic proteins. Even where eukaryotic proteins do not have posttranslational modifications, prokaryotic expression systems often lack necessary chaperone proteins required for proper folding. Yeast and fungi are attractive options for expressing proteins as they can be easily grown at a large scale in simple media, which allows low production costs, and yeast and fungi have posttranslational machinery and chaperones that perform similar functions as found in mammalian cells. Moreover, tools are available to manipulate the relatively simple genetic makeup of yeast and fungal cells as well as more complex eukaryotic cells such as mammalian or insect cells (De Pourcq et al., Appl Microbiol Biotechnol, 87(5):1617-31).

However, posttranslational modifications occurring in yeast and fungi may still be a concern for the production of recombinant therapeutic protein. In particular, insufficient N-glycosylation is one of the biggest hurdles to overcome in the production of biopharmaceuticals for human applications in fungi.

N-glycosylation, which refers to the attachment of sugar molecule to a nitrogen atom of an asparagine side chain, has been shown to modulate the pharmacokinetics and pharmacodynamics of therapeutic proteins.

Hintz et al (1995, Can. J. Bot. (Suppl 1): S876-S884) report genetic engineering of filamentous fungal cells such as Aspergillus nidulans and possible strategies for remodeling N-glycans in such host cells. Contreras et al disclose strategies for producing glycoproteins with mammalian-like N-glycans in yeast Pichia, comprising the overexpression of α1,2 mannosidae and α-glucosidase II enzyme (US2010/0267084). De pourcq et al further report the production of Man$_3$GlcNAc$_2$ N-glycan core in yeast Yarrowia lipolytica, by disrupting Alg3 gene, and overexpressing A. niger α-glucosidase II and α1,2 mannosidase. US2009/0069232 and WO2011061629 further discloses genetically engineered cells of Yarrowia for producing altered N-glycosylation form.

In contrast, U.S. Pat. No. 7,491,510 reports the use of glucosidase II mutation in Trichoderma reesei strain to increase protein secretion, possibly in combination with α1,2 mannosidase and/or glucosaminyl-transferase gene.

WO2012/069593 discloses improved methods for producing complex N-glycans and glycoproteins with mammalian-like N-glycans, using in particular novel recombinant GnTI and GnTII enzymes. WO2013/102674 further discloses filamentous fungal cells with reduced protease activity and their use in production of heterologous proteins. WO2013/174927 further discloses strategies to express fucosylation pathway in filamentous fungal cells and produce fucosylated glycoproteins.

Reports on filamentous fungal cell expression systems expressing human-like N-glycans are lacking. In particular, a need remains in the art for improved filamentous fungal cells, such as Trichoderma filamentous fungal cells, that can stably produce heterologous proteins with predominant mammalian-like N-glycans, such as predominant G0, G1 or G2 glycoform, and at high levels of expression.

SUMMARY

The present invention relates to a filamentous fungal cell which produces a heterologous glycoprotein with mammalian-like N-glycans, comprising:
  optionally, one or more mutations that reduces or eliminates one or more endogenous protease activity compared to a parental filamentous fungal cell which does not have said mutation(s), for example a deletion mutation in at least one protease encoding gene;
  a polynucleotide encoding a heterologous catalytic subunit of oligosaccharyl transferase;
  optionally, a recombinant polynucleotide for increasing α1, 2 mannosidase activity; and,
  a recombinant polynucleotide encoding said heterologous glycoprotein,
wherein at least 90% (mol %), preferably at least 95% of the total neutral N-glycans of said produced heterologous glycoprotein are from the group consisting of:
  Manα3[Manα6(Manα3)Manα6] Manβ4GlcNAcβ4GlcNAc (Man5 glycoform);
  GlcNAcβ2Manα3[Manα6(Manα3)Manα6] Manβ4GlcNAcβ4GlcNAc (GlcNAcMan5 glycoform);
  Manα6(Manα3)Manβ4GlcNAcβ4GlcNAc (Man3 glycoform);
  Manα6(GlcNAcβ2Manα3)Manβ4GlcNAcβ4GlcNAc (GlcNAcMan3 glycoform);
  complex type N-glycans selected from the G0, G1, or G2 glycoform; and,
  complex type fucosylated N-glycans FG0, FG1, or FG2 glycoform.

In one specific embodiment, the filamentous fungal cell of the invention is a Trichoderma fungal cell, a Myceliophthora fungal cell, an Aspergillus fungal cell, a Neurospora fungal cell, a Penicillium cell, a Fusarium cell, a Rhizopus cell, a Mucor cell, or a Chrysosporium fungal cell. In specific embodiments, the total protease activity in the filamentous fungal cell according to the invention is reduced to 40% or less, preferably 6% or less, of the total protease activity of the corresponding parental filamentous fungal cell in which the proteases do not have the reduced activity.

In another specific embodiment, the filamentous fungal cell of the invention further comprises a mutation in a PMT gene that reduces endogenous O-mannosyltransferase activity compared to a parental filamentous fungal cell which does not have said mutation.

In another specific embodiment, that may be combined with the preceding embodiments, the filamentous fungal cell is deficient in OCH1 activity.

In another specific embodiment, that may be combined with the preceding embodiments, the filamentous fungal cell of the invention is deficient in EndoT activity.

In another specific embodiment, that may be combined with the preceding embodiments, the filamentous fungal cell of the invention comprises a catalytic subunit of oligosaccharyl transferase selected from *Leishmania* oligosaccharyl transferase catalytic subunits.

The filamentous fungal cell of anyone of the preceding embodiments may further comprises a mutation in the gene encoding ALG3 that reduces or eliminates the corresponding ALG3 expression compared to the level of expression of ALG3 gene in a parental cell which does not have such mutation.

In one specific embodiment, the filamentous fungal cell of the invention comprises a recombinant polynucleotide for increasing α-glucosidase II activity. Typically, said recombinant polynucleotide for increasing α-glucosidase II activity is selected from the group consisting of: *Trichoderma* α-glucosidase II catalytic domain coding sequence, *Aspergillus* α-glucosidase II catalytic domain coding sequence, microalgae α-glucosidase II catalytic domain coding sequence, or, *Trypanosoma* α-glucosidase II catalytic domain coding sequence.

In another specific embodiment, that may be combined with the preceding embodiments, the filamentous fungal cell of the invention comprises
  a polynucleotide encoding an N-acetylglucosaminyltransferase I catalytic domain, preferably selected from *P. tricornutum* or *X. laevis* GnTI catalytic domain coding sequence,
  a polynucleotide encoding an N-acetylglucosaminyltransferase II catalytic domain.

In another specific embodiment, that may be combined with the preceding embodiments, the filamentous fungal cell of the invention comprises
  a polynucleotide encoding an N-acetylglucosaminyltransferase I catalytic domain, preferably selected from microalgae GnTI catalytic domain coding sequence,
  a polynucleotide encoding an N-acetylglucosaminyltransferase II catalytic domain.

The filamentous fungal cell of the invention may further comprise polynucleotides encoding respectively the following polypeptides:
  N-acetylglucosaminyltransferase I catalytic domain; preferably selected from *P. tricornutum* or *X. laevis* GnTI or microalgae GnTI coding sequence,
  α-mannosidase II; preferably, α-mannosidase II catalytic domain of *Caenorhabditis remanei* or *Culex quinquefasciatus*.
  N-acetylglucosaminyltransferase II catalytic domain; and, optionally, β1,4 galactosyltransferase activity,
  further optionally, fucosyltransferase activity and GDP fucose synthesizing activity.

In specific embodiment, the mammalian polypeptide is selected from the group consisting of an antibody and their antigen-binding fragments, a growth factor, an interferon, a cytokine, and an interleukin.

In another specific embodiment that may be combined with the preceding embodiments, the filamentous fungal cell of the invention is a *Trichoderma cell*, preferably, *Trichoderma reesei*, characterized in that:
  it is deficient in at least the following endogenous protease genes: pep1, tsp1, slp1, gap1, gap2, pep4, and pep3; and,
  it contains a recombinant nucleotide for increasing α1,2 mannosidase activity selected from the group consisting *T. reesei* α1,2 mannosidase encoding gene or *T. reesei* α1,2 mannosidase encoding gene fused to HDEL targeting sequence or microalgae α1,2 mannosidase encoding gene;
  it contains a recombinant nucleotide encoding a catalytic subunit of oligosaccharyl transferase selected from *Leishmania* oligosaccharyl transferase catalytic subunits; and,
  optionally, it is deficient in OCH1 activity, PMT1 activity and/or EndoT activity.

In a more specific embodiment of the precedent embodiment, the cell further comprises one or more polynucleotides encoding a polypeptide selected from the group consisting of:
  N-acetylglucosaminyltransferase I catalytic domain; preferably selected from *P. tricornutum* or *X. laevis* or microalgae GnTI coding sequence,
  N-acetylglucosaminyltransferase II catalytic domain; and,
  β1,4 galactosyltransferase.

In another specific embodiment, that may be combined with the two precedent embodiments, the cell is deficient in ALG3 activity. In such specific embodiment, the filamentous fungal cell of the invention may comprise a recombinant polynucleotide for increasing α-glucosidase II activity. For example, said recombinant polynucleotide for increasing expression of α-glucosidase II activity, may be selected from the group consisting of: *Trichoderma, Aspergillus,* microalgae and *Trypanosoma* α-glucosidase II catalytic domain coding sequences.

Such filamentous fungal cell of the invention may further comprise a polynucleotide encoding α-mannosidase II activity, preferably α-mannosidase II catalytic domain of *Caenorhabditis remanei* or *Culex quinquefasciatus*.

In another aspect, the invention relates to a method for producing a heterologous glycoprotein with mammalian-like N-glycan in a filamentous fungal host cell, said method comprising:
  (i) providing a filamentous fungal cell according to the invention as defined above,
  (ii) culturing said filamentous fungal cell to produce said heterologous glycoprotein,
  (iii) isolating said heterologous glycoprotein.

In a preferred embodiment of the method, at least 90% (mol %), preferably at least 95% of the total neutral N-glycans of said produced heterologous glycoprotein are from the group consisting of: G0, G1, and/or G2 glycoform, or their fucosylated glycoforms.

In specific embodiments of the method, said heterologous glycoprotein is a mammalian glycoprotein.

For example, said heterologous glycoprotein is selected from the group consisting of an antibody, an immunoglobulin or a protein fusion comprising Fc fragment of an immunoglobulin or their glycosylated antigen-binding fragment.

The invention also relates to a glycoprotein or antibody obtainable by the methods of any one of the invention as defined above.

DESCRIPTION OF THE FIGURES

FIG. 1. The glycan masses, compositions, abbreviations and corresponding structures used in tables, MALDI-TOF MS images and text.

DETAILED DESCRIPTION

Definitions

Figure 2:
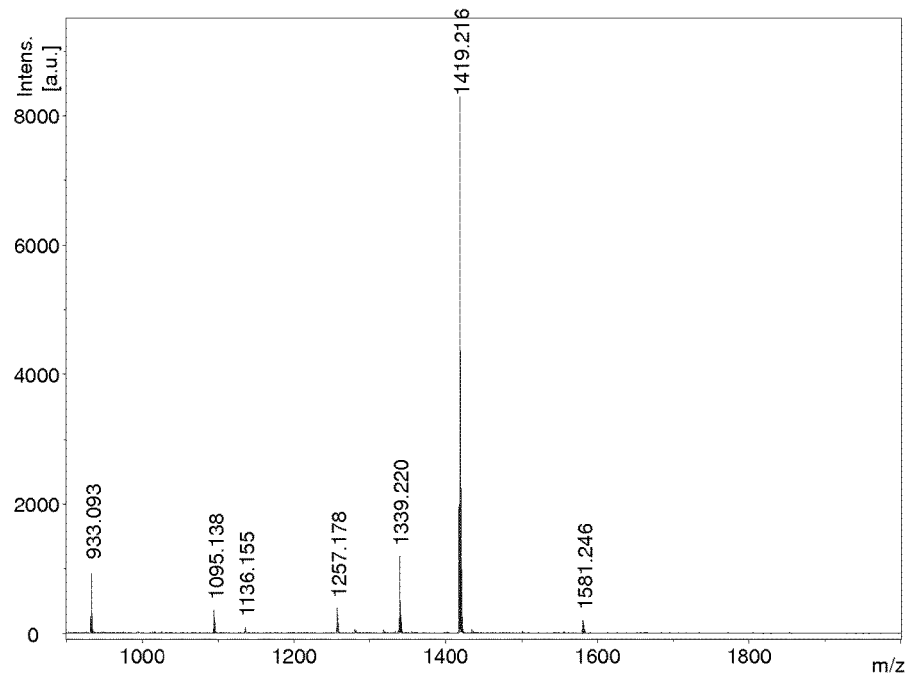
FIG. 2. MALDI-TOF MS image of neutral N-glycans released from Rituximab from strain M290 fermented for 5 days.

As used herein, an "expression system" or a "host cell" refers to the cell that is genetically modified to enable the transcription, translation and proper folding of a polypeptide or a protein of interest, typically of mammalian protein.

The term "polynucleotide" or "oligonucleotide" or "nucleic acid" as used herein typically refers to a polymer of at least two nucleotides joined together by a phosphodiester bond and may consist of either ribonucleotides or deoxynucleotides or their derivatives that can be introduced into a host cell for genetic modification of such host cell. For example, a polynucleotide may encode a coding sequence of a protein, and/or comprise control or regulatory sequences of a coding sequence of a protein, such as enhancer or promoter sequences or terminator. A polynucleotide may for example comprise native coding sequence of a gene or their fragments, or variant sequences that have been optimized for optimal gene expression in a specific host cell (for example to take into account codon bias).

As used herein, the term, "optimized" with reference to a polynucleotide means that a polynucleotide has been altered to encode an amino acid sequence using codons that are preferred in the production cell or organism, for example, a filamentous fungal cell such as a *Trichoderma* cell. Heterologous nucleotide sequences that are transfected in a host cell are typically optimized to retain completely or as much as possible the amino acid sequence originally encoded by the original (not optimized) nucleotide sequence. The optimized sequences herein have been engineered to have codons that are preferred in the corresponding production cell or organism, for example the filamentous fungal cell. The amino acid sequences encoded by optimized nucleotide sequences may also be referred to as optimized.

As used herein, a "peptide" or a "polypeptide" is an amino acid sequence including a plurality of consecutive polymerized amino acid residues. The peptide or polypeptide may include modified amino acid residues, naturally occurring amino acid residues not encoded by a codon, and non-naturally occurring amino acid residues. As used herein, a "protein" may refer to a peptide or a polypeptide or a combination of more than one peptide or polypeptide assembled together by covalent or non-covalent bonds. Unless specified, the term "protein" or "polypeptide" may encompass one or more amino acid sequences with their post-translation modifications, and in particular with either O-mannosylation or N-glycan modifications.

As used herein, the term "glycoprotein" refers to a polypeptide or protein which comprises at least one N-linked glycan attached to at least one asparagine residue of a protein, and/or at least one mannose attached to at least one serine or threonine resulting in O-mannosylation. Since glycoproteins as produced in a host cell expression system are usually produced as a mixture of different glycosylation patterns, the terms "glycoprotein" or "glycoprotein composition" is used interchangeably and encompass the mixtures of glycoproteins as produced by a host cell, with different glycosylation patterns, unless specifically defined.

The terms "N-glycosylation" or "oligosaccharyl transferase activity" are used herein to refer to the covalent linkage of at least an oligosaccharide chain to the side-chain amide nitrogen of asparagine residue (Asn) of a polypeptide.

As used herein, "glycan" refers to an oligosaccharide chain that can be linked to a carrier such as an amino acid, peptide, polypeptide, lipid or a reducing end conjugate. In certain embodiments, the invention relates to N-linked glycans ("N-glycan") conjugated to a polypeptide N-glycosylation site such as -Asn-Xaa-Ser/Thr- by N-linkage to side-chain amide nitrogen of asparagine residue (Asn), where Xaa is any amino acid residue except Pro. The invention may further relate to glycans as part of dolichol-phospho-oligosaccharide (Dol-P-P-OS) precursor lipid structures, which are precursors of N-linked glycans in the endoplasmic reticulum of eukaryotic cells. The precursor oligosaccharides are linked from their reducing end to two phosphate residues on the dolichol lipid. For example, a3-mannosyltransferase Alg3 modifies the Dol-P-P-oligosaccharide precursor of N-glycans. Generally, the glycan structures described herein are terminal glycan structures, where the non-reducing residues are not modified by other monosaccharide residue or residues.

As used throughout the present disclosure, glycolipid and carbohydrate nomenclature is essentially according to recommendations by the IUPAC-IUB Commission on Biochemical Nomenclature (e.g. Carbohydrate Res. 1998, 312, 167; Carbohydrate Res. 1997, 297, 1; Eur. J. Biochem. 1998, 257, 29). It is assumed that Gal (galactose), Glc (glucose), GlcNAc (N-acetylglucosamine), GalNAc (N-acetylgalactosamine), Man (mannose), and Neu5Ac are of the D-configuration, Fuc of the L-configuration, and all the monosaccharide units in the pyranose form (D-Galp, D-Glcp, D-GlcpNAc, D-GalpNAc, D-Manp, L-Fucp, D-Neup5Ac). The amine group is as defined for natural galactose and glucosamines on the 2-position of GalNAc or GlcNAc. Glycosidic linkages are shown partly in shorter and partly in longer nomenclature, the linkages of the sialic acid SA/Neu5X-residues α3 and α6 mean the same as α2-3 and α2-6, respectively, and for hexose monosaccharide residues α1-3, α1-6, β1-2, β1-3, β1-4, and β1-6 can be shortened as α3, α6, β2, β3, β4, and β6, respectively. Lactosamine refers to type II N-acetyllactosamine, Galβ4GlcNAc, and/or type I N-acetyllactosamine. Galβ3GlcNAc and sialic acid (SA) refer to N-acetylneuraminic acid (Neu5Ac), N-glycolylneuraminic acid (Neu5Gc), or any other natural sialic acid including derivatives of Neu5X. Sialic acid is referred to as NeuNX or Neu5X, where preferably X is Ac or Gc. Occasionally Neu5Ac/Gc/X may be referred to as NeuNAc/NeuNGc/NeuNX.

The sugars typically constituting N-glycans found in mammalian glycoprotein, include, without limitation, N-acetylglucosamine (abbreviated hereafter as "GlcNAc"), mannose (abbreviated hereafter as "Man"), glucose (abbreviated hereafter as "Glc"), galactose (abbreviated hereafter as "Gal"), and sialic acid (abbreviated hereafter as "Neu5Ac"). N-glycans share a common pentasaccharide referred to as the "core" structure Man₃GlcNAc₂ (Manα6(Manα3)Manβ4GlcNAβ4GlcNAc, referred to as Man3).

Man3 glycan includes its derivative Manα6 (GlcNAcβ2Manα3)Manβ4GlcNAβ4GlcNAc (GlcNAc-Man3). When a fucose is attached to the core structure, preferably α6-linked to reducing end GlcNAc, the N-glycan or the core of N-glycan, may be represented as Man₃GlcNAc₂(Fuc).

Hybrid type N-glycans comprise GlcNAcβ2Manα3 [Manα6(Manα3)Manα6]Manβ4GlcNAβ4GlcNAc ("GlcNAcMan5"), or b4-galactosylated derivatives thereof Galβ4GlcNAcMan3, G1, G2, or GalGlcNAcMan5 glycoform.

A "complex N-glycan" refers to a N-glycan which has at least one GlcNAc residue, optionally by GlcNAcβ2-residue, on terminal 1,3 mannose arm of the core structure and at least one GlcNAc residue, optionally by GlcNAcβ2-residue, on terminal 1,6 mannose arm of the core structure.

Such complex N-glycans include, without limitation, GlcNAc₂Man₃GlcNAc₂ (also referred as G0 glycoform), Gal₁GlcNAc₂Man₃GlcNAc₂ (also referred as G1 glycoform), and Gal₂GlcNAc₂Man₃GlcNAc₂ (also referred as G2 glycoform), and their core fucosylated glycoforms FG0, FG1 and FG2, respectively GlcNAc₂Man₃GlcNAc₂(Fuc), Gal₁GlcNAc₂Man₃GlcNAc₂(Fuc), and Gal₂GlcNAc₂Man₃GlcNAc₂(Fuc).

As used herein, the expression "neutral N-glycan" has its general meaning in the art. It refers to non-sialylated N-glycans. In contrast, sialylated N-glycans are acidic.

"Increased" or "Reduced activity of an endogenous enzyme": The filamentous fungal cell may have increased or reduced levels of activity of various endogenous enzymes. A reduced level of activity may be provided by inhibiting the activity of the endogenous enzyme with an inhibitor, an antibody, or the like. In certain embodiments, the filamentous fungal cell is genetically modified in ways to increase or reduce activity of various endogenous enzymes. "Genetically modified" refers to any recombinant DNA or RNA method used to create a prokaryotic or eukaryotic host cell that expresses a polypeptide at elevated levels, at lowered levels, or in a mutated form. In other words, the host cell has been transfected, transformed, or transduced with a recombinant polynucleotide molecule, and thereby been altered so as to cause the cell to alter expression of a desired protein.

"Genetic modifications" which result in a decrease or deficiency in gene expression, in the function of the gene, or in the function of the gene product (i.e., the protein encoded by the gene) can be referred to as inactivation (complete or partial), knock-out, deletion, disruption, interruption, blockage, silencing, or down-regulation, or attenuation of expression of a gene. For example, a genetic modification in a gene which results in a decrease in the function of the protein encoded by such gene, can be the result of a complete deletion of the gene (i.e., the gene does not exist, and therefore the protein does not exist), a mutation in the gene which results in incomplete (disruption) or no translation of the protein (e.g., the protein is not expressed), or a mutation in the gene which decreases or abolishes the natural function of the protein (e.g., a protein is expressed which has decreased or no enzymatic activity or action). More specifically, reference to decreasing the action of proteins discussed herein generally refers to any genetic modification in the host cell in question, which results in decreased expression and/or functionality (biological activity) of the proteins and includes decreased activity of the proteins (e.g., decreased catalysis), increased inhibition or degradation of the proteins as well as a reduction or elimination of expression of the proteins. For example, the action or activity of a protein can be decreased by blocking or reducing the production of the protein, reducing protein action, or inhibiting the action of the protein. Combinations of some of these modifications are also possible. Blocking or reducing the production of a protein can include placing the gene encoding the protein under the control of a promoter that requires the presence of an inducing compound in the growth medium. By establishing conditions such that the inducer becomes depleted from the medium, the expression of the gene encoding the protein (and therefore, of protein synthesis) could be turned off. Blocking or reducing the action of a protein could also include using an excision technology approach similar to that described in U.S. Pat. No. 4,743, 546. To use this approach, the gene encoding the protein of interest is cloned between specific genetic sequences that allow specific, controlled excision of the gene from the genome. Excision could be prompted by, for example, a shift in the cultivation temperature of the culture, as in U.S. Pat. No. 4,743,546, or by some other physical or nutritional signal.

In general, according to the present invention, an increase or a decrease in a given characteristic of a mutant or modified protein (e.g., enzyme activity) is made with reference to the same characteristic of a parent (i.e., normal, not modified) protein that is derived from the same organism (from the same source or parent sequence), which is measured or established under the same or equivalent conditions. Similarly, an increase or decrease in a characteristic of a genetically modified host cell (e.g., expression and/or biological activity of a protein, or production of a product) is made with reference to the same characteristic of a wild-type host cell of the same species, and preferably the same strain, under the same or equivalent conditions. Such conditions include the assay or culture conditions (e.g., medium components, temperature, pH, etc.) under which the activity of the protein (e.g., expression or biological activity) or other characteristic of the host cell is measured, as well as the type of assay used, the host cell that is evaluated, etc. As discussed above, equivalent conditions are conditions (e.g., culture conditions) which are similar, but not necessarily identical (e.g., some conservative changes in conditions can be tolerated), and which do not substantially change the effect on cell growth or enzyme expression or biological activity as compared to a comparison made under the same conditions.

For example, a genetically modified host cell that has a genetic modification that increases or decreases (reduces) the activity of a given protein (e.g., a protease) may have an increase or decrease, respectively, in the activity or action (e.g., expression, production and/or biological activity) of the protein, as compared to the activity of the protein in a parent host cell (which does not have such genetic modification), of at least about 5%, or at least about 10%, 15%, 20%, 25%, 30%, 35%, 40%, 45%, 50%, 55 60%, 65%, 70%, 75 80%, 85 90%, 95%, or any percentage, in whole integers between 5% and 100% (e.g., 6%, 7%, 8%, etc.).

In another aspect of the invention, a genetically modified host cell that has a genetic modification that increases or decreases (reduces) the activity of a given protein (e.g., a protease) has an increase or decrease, respectively, in the activity or action (e.g., expression, production and/or biological activity) of the protein, as compared to the activity of the wild-type protein in a parent host cell, of at least about 2-fold, and for example at least about 5-fold, 10-fold, 20-fold, 30-fold, 40-fold, 50-fold, 75-fold, 100-fold, 125-fold, 150-fold, or any whole integer increment starting from at least about 2-fold (e.g., 3-fold, 4-fold, 5-fold, 6-fold, etc.).

As used herein, the terms "identical" or "per cent identity," in the context of two or more nucleic acid or amino acid sequences, refers to two or more sequences or subsequences that are the same. Two sequences are "substantially identical" if two sequences have a specified percentage of amino acid residues or nucleotides that are the same (i.e., 29% identity, optionally 30%, 40%, 45%, 50%, 55%, 60%, 65%, 70%, 75%, 80%, 85%, 90%, 95%, 99% or 100% identity over a specified region, or, when not specified, over the entire sequence), when compared and aligned for maximum correspondence over a comparison window, or designated region as measured using one of the following sequence comparison algorithms or by manual alignment and visual inspection. Optionally, the identity exists over a region that is at least about 50 nucleotides (or 10 amino acids) in length, or for example over a region that is 100 to 500 or 1000 or more nucleotides (or 20, 50, 200, or more amino acids) in length.

For sequence comparison, typically one sequence acts as a reference sequence, to which test sequences are compared. When using a sequence comparison algorithm, test and reference sequences are entered into a computer, subsequence coordinates are designated, if necessary, and sequence algorithm program parameters are designated. Default program parameters can be used, or alternative parameters can be designated. The sequence comparison algorithm then calculates the percent sequence identities for the test sequences relative to the reference sequence, based on the program parameters. When comparing two sequences for identity, it is not necessary that the sequences be contiguous, but any gap would carry with it a penalty that would reduce the overall percent identity. For blastn, the default parameters are Gap opening penalty=5 and Gap extension penalty=2. For blastp, the default parameters are Gap opening penalty=11 and Gap extension penalty=1.

A "comparison window," as used herein, includes reference to a segment of any one of the number of contiguous positions including, but not limited to from 20 to 600, usually about 50 to about 200, more usually about 100 to about 150 in which a sequence may be compared to a reference sequence of the same number of contiguous positions after the two sequences are optimally aligned. Methods of alignment of sequences for comparison are well known in the art. Optimal alignment of sequences for comparison can be conducted, e.g., by the local homology algorithm of Smith and Waterman (1981), by the homology alignment algorithm of Needleman and Wunsch (1970) J Mol Biol 48(3):443-453, by the search for similarity method of Pearson and Lipman (1988) Proc Natl Acad Sci USA 85(8): 2444-2448, by computerized implementations of these algorithms (GAP, BESTFIT, FASTA, and TFASTA in the Wisconsin Genetics Software Package, Genetics Computer Group, 575 Science Dr., Madison, Wis.), or by manual alignment and visual inspection [see, e.g., Brent et al., (2003) Current Protocols in Molecular Biology, John Wiley & Sons, Inc. (Ringbou Ed)].

Two examples of algorithms that are suitable for determining percent sequence identity and sequence similarity are the BLAST and BLAST 2.0 algorithms, which are described in Altschul et al. (1997) Nucleic Acids Res 25(17): 3389-3402 and Altschul et al. (1990) J. Mol Biol 215(3)-403-410, respectively. Software for performing BLAST analyses is publicly available through the National Center for Biotechnology Information. The BLASTN program (for nucleotide sequences) uses as defaults a word length (W) of 11, an expectation (E) or 10, M=5, N=−4, and a comparison of both strands. For amino acid sequences, the BLASTP program uses as defaults a word length of 3, and expectation (E) of 10, and the BLOSUM62 scoring matrix [see Henikoff and Henikoff, (1992) Proc Natl Acad Sci USA 89(22)10915-

10919] alignments (B) of 50, expectation (E) of 10, M=5, N=−4, and a comparison of both strands.

The BLAST algorithm also performs a statistical analysis of the similarity between two sequences (see, e.g., Karlin and Altschul, (1993) Proc Natl Acad Sci USA 90(12):5873-5877). One measure of similarity provided by the BLAST algorithm is the smallest sum probability (P(N)), which provides an indication of the probability by which a match between two nucleotide or amino acid sequences would occur by chance. For example, a nucleic acid is considered similar to a reference sequence if the smallest sum probability in a comparison of the test nucleic acid to the reference nucleic acid is less than about 0.2, more preferably less than about 0.01, and most preferably less than about 0.001.

"Functional variant" or "functional homologous gene" as used herein refers to a coding sequence or a protein having sequence similarity with a reference sequence, typically, at least 30%, 40%, 50%, 60%, 70%, 80%, 90% or 95% identity with the reference coding sequence or protein, and retaining substantially the same function as said reference coding sequence or protein. A functional variant may retain the same function but with reduced or increased activity. Functional variants include natural variants, for example, homologs from different species or artificial variants, resulting from the introduction of a mutation in the coding sequence. Functional variant may be a variant with only conservatively modified mutations.

"Conservatively modified mutations" as used herein include individual substitutions, deletions or additions to an encoded amino acid sequence which result in the substitution of an amino acid with a chemically similar amino acid. Conservative substitution tables providing functionally similar amino acids are well known in the art. Such conservatively modified variants are in addition to and do not exclude polymorphic variants, interspecies homologs, and alleles of the disclosure. The following eight groups contain amino acids that are conservative substitutions for one another: 1) Alanine (A), Glycine (G); 2) Aspartic acid (D), Glutamic acid (E); 3) Asparagine (N), Glutamine (Q); 4) Arginine (R), Lysine (K); 5) Isoleucine (I), Leucine (L), Methionine (M), Valine (V); 6) Phenylalanine (F), Tyrosine (Y), Tryptophan (W); 7) Serine (S), Threonine (T); and 8) Cysteine (C), Methionine (M) (see, e.g., Creighton, Proteins (1984)).

Filamentous Fungal Cells

As used herein, "filamentous fungal cell" include cells from all filamentous forms of the subdivision Eumycota and Oomycota (as defined by Hawksworth et al., In, Ainsworth and Bisby's Dictionary of The Fungi, 8th edition, 1995, CAB International, University Press, Cambridge, UK). Filamentous fungal cells are generally characterized by a mycelial wall composed of chitin, cellulose, glucan, chitosan, mannan, and other complex polysaccharides. Vegetative growth is by hyphal elongation and carbon catabolism is obligately aerobic. In contrast, vegetative growth by yeasts such as *Saccharomyces cerevisiae* is by budding of a unicellular thallus and carbon catabolism may be fermentative.

Preferably, the filamentous fungal cell is not adversely affected by the transduction of the necessary nucleic acid sequences, the subsequent expression of the proteins (e.g., mammalian proteins), or the resulting intermediates. General methods to disrupt genes of and cultivate filamentous fungal cells are disclosed, for example, for *Penicillium*, in Kopke et al. (2010) Appl Environ Microbiol. 76(14):4664-74. doi: 10.1128/AEM.00670-10, for *Aspergillus*, in Maruyama and Kitamoto (2011), Methods in Molecular Biology, vol. 765, D0110.1007/978-1-61779-197-0_27; for Neurospora, in Collopy et al. (2010) Methods Mol Biol. 2010;638:33-40. doi: 10.1007/978-1-60761-611-5_3; and for *Myceliophthora* or *Chrysosporium* PCT/NL2010/000045 and PCT/EP98/06496. A method to transform filamentous fungal cells include *Agrobacterium* mediated transformation. Gene transformation method based on *Agrobacterium tumefaciens* T-DNA transfer to host cell has been originally developed with plants. It has been applied to yeasts (Bundock et al. (1995) EMBO J 14:3206-3214) and filamentous fungi (de Groot et al. (1998) Nat Biotechnol 16:839-842). If the T-DNA includes homologous regions with fungal genome, the integration to host cell can occur through homologous recombination, thus, enabeling targeted knockouts and gene replacements (Gouka et al. (1999) Nat Biotechnol 17:598-601) (Zeilinger (2004) Curr Genet 45:54-60) (Zwiers and De Waard (2001) Curr Genet 39:388-393) (Zhang et al. (2003) Mol Gen Genomics 268:645-655).

In general, the expression cassette with gene of interest and promoter/terminator sequences functional in fungal host can be flanked with sequences homologus to the regions flanking the sequence to be knocked out from fungal genome. Cassette with homologous flanks is then inserted to Agrobacterium tumefaciens binary vector between the T-DNA borders, left border and right border. Binary vector can be electroporated to Agrobacterium tumefaciens strain like C58C1 pGV2260 or LBA pAL4404 containing the helper plasmid encoding vir proteins needed for T-DNA transfer.

Co-cultivation of *Trichoderma reesei* and *Agrobacterium* can be made by mixing the fungal spores or pre-germinated spores or protoplasts with *Agrobacterium* suspension culture and plating the mixture to sterile cellophane disks placed on top of the transformation plates. On the absence of wounded plant tissue, vir- gene induction can be launched by the presence of inducing agents in the culture media, like asetosyringone. After of two days of co-cultivation, sellophane disks can be transferred on top of selection plates, containing the selective agent for transformed *Trichoderma* cells and an antibiotic agent inhibiting the *Agrobacterium* growth with no adverse effects on *Trichoderma,* like ticarcillin. Once the transformed fungal colonies appear, they can be picked and purified through single spore cultures, as routinely done with other transformation methods.

A method to disrupt genes of filamentous fungal cells include CRISPR-CAS system, or clustered regularly interspaced short palindromic repeats. CRISPR-Cas system is a novel technique of gene editing (silencing, enhancing or changing specific genes). By inserting a plasmid containing cas9 genes and specifically designed CRISPRs, the organism's genome can be cut at any desired location. Cas9 gene originates from the type II bacterial CRISPR system of *Streptococcus* pyogenes. Gene product, CAS9 nuclease, complexes with a specific genome targeting CRISPR guideRNA and has high site specificity of the DNA cutting activity. It has been shown recently that CAS9 can function as an RNA-guided endonuclease in various heterologous organisms (Mali et al. 2013: Rna guided human genome engineering via Cas9. Science 339:823-826; Cong et al 2013: Multiplex genome engineering using CRISPR-Cas systems. Science 339:819-823; Jiang et al 2013: RNA-guided editing of bacterial genomes using CRISPR-Cas systems. Nat Biotechnol 31:233-239; Jinek et al. 2013: RNA programmed genome editing in human cells. eLife 2:e00471; Hwang et al. 2013: Efficient genome editing in zebrafish using a CRISPR-Cas system. Nat Biotech 31:227-279. DiCarlo et al 2013: Genome engineering in *Saccharo-* myces cerevisiae using CRISPR-Cas systems. NAR 41:4336-4343, or Arazoef et al. Tailor-made CRISPR/Cas system for highly efficient targeted gene replacement in the rice blast fungus. Biotechnol Bioeng. 2015 Jun 3. doi: 10.1002/bit.25662).

GuideRNA synthesis have been usually carried out from promoters transcribed by RNA polymerase III, most commonly used being SNR52 snoRNA promoter in yeasts and U3/U6 snoRNA promoters in plants and animals. Promoters transcribed by RNA polymerase II have been considered to be unsuitable for guideRNA synthesis because of the post-transcriptional modifications, 5'capping, 573' UTR's and poly A tailing. However, it has been recently demonstrated that RNA polymerase II type promoters can be used if the guideRNA sequence is flanked with self-processing ribozyme sequences. Primary transcript then undergoes self-catalyzed cleavage and generates desired gRNA sequence (Gao and Zhao 2014: Self processing of ribozyme-flanked RNAs into guide RNA's in vitro and in vivo for CRISPR-mediated genome editing. Journal of Integrative Plant Biology e-publication ahead of print; March 2014). Example 18 exemplifies methods to disrupt various genes that affect and/or hinder efficient production of heterologous proteins in *T. reesei*.

Examples of suitable filamentous fungal cells include, without limitation, cells from an *Acremonium, Aspergillus, Fusarium, Humicola, Mucor, Myceliophthora, Neurospora, Penicillium, Scytalidium, Thielavia, Tolypocladium*, or *Trichoderma/Hypocrea* strain.

In certain embodiments, the filamentous fungal cell is from a *Trichoderma* sp., *Acremonium, Aspergillus, Aureobasidium, Cryptococcus, Chrysosporium, Chrysosporium lucknowense, Filibasidium, Fusarium, Gibberella, Magnaporthe, Mucor, Myceliophthora, Myrothecium, Neocallimastix, Neurospora, Paecilomyces, Penicillium, Piromyces, Schizophyllum, Talaromyces, Thermoascus, Thielavia*, or *Tolypocladium* cell.

In some embodiments, the filamentous fungal cell is a *Myceliophthora* or *Chrysosporium, Neurospora, Penicillium, Rhizopus, Mucor, Aspergillus, Fusarium* or *Trichoderma* cell.

*Aspergillus* fungal cells of the present disclosure may include, without limitation, *Aspergillus aculeatus, Aspergillus awamori, Aspergillus clavatus, Aspergillus flavus, Aspergillus foetidus, Aspergillus fumigatus, Aspergillus japonicus, Aspergillus nidulans, Aspergillus niger, Aspergillus oryzae*, or *Aspergillus terreus*.

*Neurospora* fungal cells of the present disclosure may include, without limitation, *Neurospora crassa*.

*Myceliophthora* fungal cells of the present disclosure may include, without limitation, *Myceliophthora thermophila*.

*Rhizopus* fungal cells of the present disclosure may include, without limitation, *Rhizopus oryzae* or *Rhizopus arrhizus, Rhizomucor miehei* and *Rhizomucor pusillus*.

*Mucor* fungal cells of the present disclosure may include, without limitation, *Mucor circinelloides*.

*Penicillium* fungal cells of the present disclosure may include, without limitation, *Penicillium purpurogenum, Penicillium griseoroseum, Penicillium oxalicum, Penicillium expansum, Penicillium chrysogenum, Penicillium purpurogenum, Penicillium funiculosum, Penicillium camemberti, Penicillium roqueforti*, and *Penicillium (Talaromyces) emersonii*.

*Fusarium* fungal cells of the present disclosure may include, without limitation, *Fusarium solani* and *Fusarium graminearum*.

In a preferred embodiment, the filamentous fungal cell is a *Trichoderma* fungal cell. *Trichoderma* fungal cells of the present disclosure may be derived from a wild-type *Trichoderma* strain or a mutant thereof. Examples of suitable *Trichoderma* fungal cells include, without limitation, *Trichoderma harzianum, Trichoderma koningii, Trichoderma longibrachiatum, Trichoderma reesei, Trichoderma asperellum, Trichoderma atroviride, Trichoderma virens, Trichoderma viride*; and alternative sexual form thereof (i.e., *Hypocrea*).

In a more preferred embodiment, the filamentous fungal cell is a *Trichoderma reesei*, and for example, strains derived from ATCC 13631 (QM 6a), ATCC 24449 (radiation mutant 207 of QM 6a), ATCC 26921 (QM 9414; mutant of ATCC 24449), VTT-D-00775 (Selinheimo et al., FEBS J., 2006, 273: 4322-4335), Rut-C30 (ATCC 56765), RL-P37 (NRRL 15709) or *T. harzianum* isolate T3 (Wolffhechel, H., 1989).

The invention described herein relates to a filamentous fungal cell, for example selected from *Aspergillus, Chrysosporium, Neurospora, Myceliophthora, Fusarium, Rhizopus, Mucor, Penicillium* and a *Trichoderma* cell, such as *Trichoderma reesei* fungal cell, comprising:

i. optionally, one or more mutations that reduces or eliminates one or more endogenous protease activity compared to a parental filamentous fungal cell which does not have said mutation(s); for example a deletion mutation in at least one protease encoding gene ii. a polynucleotide encoding a heterologous catalytic subunit of oligosaccharyl transferase;

iii. optionally, a recombinant polynucleotide for increasing α1, 2 mannosidase activity; and, iv. a recombinant polynucleotide encoding a heterologous glycoprotein, wherein at least 90% (mol %), preferably at least 95% of the total neutral N-glycans of said recombinant glycoprotein as produced in said filamentous fungal cell, are from the group consisting of:

Manα3[Manα6(Manα3)Manα6]
Manβ4GlcNAβ4GlcNAc (Man5 glycoform);

GlcNAcβ2Manα3[Manα6(Manα3)Manα6]
Manβ4GlcNAβ4GlcNAc (GlcNAcMan5 glycoform);

Manα6(Manα3)Manβ4GlcNAβ4GlcNAc (Man3 glycoform);

Manα6(GlcNAcβ2Manα3)Manβ4GlcNAβ4GlcNAc (GlcNAcMan3 glycoform);

complex type N-glycans selected from the G0, G1, or G2 glycoform; and, complex type fucosylated N-glycans FG0, FG1, or FG2 glycoform.

Proteases with Reduced Activity

Reducing protease activity enables to increase substantially the production of heterologous mammalian protein. Indeed, such proteases found in filamentous fungal cells that express a heterologous protein normally catalyse significant degradation of the expressed recombinant protein. Thus, by reducing or eliminating the activity of proteases in filamentous fungal cells that express a heterologous protein, the stability of the expressed protein is increased, resulting in an increased level of production of the protein, and in some circumstances, improved quality of the produced protein (e.g., full-length instead of degraded).

Proteases include, without limitation, aspartic proteases, trypsin-like serine proteases, subtilisin proteases, glutamic proteases, and sedolisin proteases. Such proteases may be identified and isolated from filamentous fungal cells and tested to determine whether reduction in their activity affects the production of a recombinant polypeptide from the filamentous fungal cell. Methods for identifying and isolating proteases are well known in the art, and include, without limitation, affinity chromatography, zymogram assays, and gel electrophoresis. An identified protease may then be tested by deleting the gene encoding the identified protease from a filamentous fungal cell that expresses a recombinant polypeptide, such a heterologous or mammalian polypeptide, and determining whether the deletion results in a decrease in total protease activity of the cell, and an increase in the level of production of the expressed recombinant polypeptide. Methods for deleting genes, measuring total protease activity, and measuring levels of produced protein are well known in the art and include the methods described herein.

Aspartic Proteases

Aspartic proteases are enzymes that use an aspartate residue for hydrolysis of the peptide bonds in polypeptides and proteins. Typically, aspartic proteases contain two highly-conserved aspartate residues in their active site which are optimally active at acidic pH. Aspartic proteases from eukaryotic organisms such as *Trichoderma* fungi include pepsins, cathepsins, and renins. Such aspartic proteases have a two-domain structure, which is thought to arise from ancestral gene duplication. Consistent with such a duplication event, the overall fold of each domain is similar, though the sequences of the two domains have begun to diverge. Each domain contributes one of the catalytic aspartate residues. The active site is in a cleft formed by the two domains of the aspartic proteases. Eukaryotic aspartic proteases further include conserved disulfide bridges, which can assist in identification of the polypeptides as being aspartic acid proteases.

Ten aspartic proteases have been identified in *Trichoderma* fungal cells: pep1 (tre74156); pep2 (tre53961); pep3 (tre121133); pep4 (tre77579), pep5 (tre81004), pep7 (tre58669), pep8 (tre122076), pep9 (tre79807), pep11 (121306), and pep12 (tre119876).

Examples of suitable aspartic proteases include, without limitation, *Trichoderma reesei* pep1 (SEQ ID NO: 1), *Trichoderma reesei* pep2 (SEQ ID NO: 2), *Trichoderma reesei* pep3 (SEQ ID NO: 3); *Trichoderma reesei* pep4 (SEQ ID NO: 4), *Trichoderma reesei* pep5 (SEQ ID NO: 5) and *Trichoderma reesei* pep7 (SEQ ID NO:6), *Trichoderma reesei* EGR48424 pep8 (SEQ ID NO:7), *Trichoderma reesei* pep9 (SEQ ID NO:8), *Trichoderma reesei* EGR49498 pep11 (SEQ ID NO:9), *Trichoderma reesei* EGR52517 pep12 (SEQ ID NO:10), and homologs thereof.

Examples of homologs of pep1, pep2, pep3, pep4, pep5, pep7, pep8, pep11 and pep12 proteases identified in other organisms are also described in WO2013/102674, the content of which being incorporated by reference.

Trypsin-Like Serine Proteases

Trypsin-like serine proteases are enzymes with substrate specificity similar to that of trypsin. Trypsin-like serine proteases use a serine residue for hydrolysis of the peptide bonds in polypeptides and proteins. Typically, trypsin-like serine proteases cleave peptide bonds following a positively-charged amino acid residue. Trypsin-like serine proteases from eukaryotic organisms such as *Trichoderma* fungi include trypsin 1, trypsin 2, and mesotrypsin. Such trypsin-like serine proteases generally contain a catalytic triad of three amino acid residues (such as histidine, aspartate, and serine) that form a charge relay that serves to make the active site serine nucleophilic. Eukaryotic trypsin-like serine proteases further include an "oxyanion hole" formed by the backbone amide hydrogen atoms of glycine and serine, which can assist in identification of the polypeptides as being trypsin-like serine proteases.

One trypsin-like serine protease has been identified in *Trichoderma* fungal cells: tsp1 (tre73897). As discussed in WO2013/102674, tsp1 has been demonstrated to have a significant impact on expression of recombinant glycoproteins, such as immunoglobulins.

Examples of suitable tsp1 proteases include, without limitation, *Trichoderma reesei* tsp1 (SEQ ID NO: 11) and homologs thereof. Examples of homologs of tsp1 proteases identified in other organisms are described in WO2013/102674.

Subtilisin Proteases

Subtilisin proteases are enzymes with substrate specificity similar to that of subtilisin. Subtilisin proteases use a serine residue for hydrolysis of the peptide bonds in polypeptides and proteins. Generally, subtilisin proteases are serine proteases that contain a catalytic triad of the three amino acids aspartate, histidine, and serine. The arrangement of these catalytic residues is shared with the prototypical subtilisin from *Bacillus licheniformis*. Subtilisin proteases from eukaryotic organisms such as *Trichoderma* fungi include furin, MBTPS1, and TPP2. Eukaryotic trypsin-like serine proteases further include an aspartic acid residue in the oxyanion hole.

Seven subtilisin proteases have been identified in *Trichoderma* fungal cells: slp1 (tre51365); slp2 (tre123244); slp3 (tre123234); slp5 (tre64719), slp6 (tre121495), slp7 (tre123865), and slp8 (tre58698). Subtilisin protease slp7 resembles also sedolisin protease tpp1.

Examples of suitable slp proteases include, without limitation, *Trichoderma reesei* slp1 (SEQ ID NO: 12), slp2 (SEQ ID NO: 13); slp3 (SEQ ID NO: 14); slp5 (SEQ ID NO: 15), slp6 (SEQ ID NO: 16), slp7 (SEQ ID NO: 17), and slp8 (SEQ ID NO: 18), and homologs thereof. Examples of homologs of slp proteases identified in other organisms are described in in WO2013/102674.

Glutamic Proteases

Glutamic proteases are enzymes that hydrolyse the peptide bonds in polypeptides and proteins. Glutamic proteases are insensitive to pepstatin A, and so are sometimes referred to as pepstatin insensitive acid proteases. While glutamic proteases were previously grouped with the aspartic proteases and often jointly referred to as acid proteases, it has been recently found that glutamic proteases have very different active site residues than aspartic proteases.

Two glutamic proteases have been identified in *Trichoderma* fungal cells: gap1 (tre69555) and gap2 (tre106661).

Examples of suitable gap proteases include, without limitation, *Trichoderma reesei* gap1 (SEQ ID NO: 19), *Trichoderma reesei* gap2 (SEQ ID NO: 20), and homologs thereof. Examples of homologs of gap proteases identified in other organisms are described in WO2013/102674.

Aminopeptidase Proteases

Aminopeptidases catalyze the cleavage of amino acids from the amino terminus of protein or peptide substrates. They are widely distributed throughout the animal and plant kingdoms and are found in many subcellular organelles, in cytoplasm, and as membrane components. Many, but not all, of these peptidases are zinc metalloenzymes. Amp2 is a bifunctional enzyme. It is a leukotriene A4 hydrolase with aminopeptidase activity (EC 3.3.2.6).

Two aminopeptidases have been identified in *Trichoderma* fungal cells: amp1 (tre81070) and amp2 (tre108592).

Examples of suitable amp1 proteases include, without limitation, *Trichoderma reesei* amp1 81070 (SEQ ID NO: 21), *T. virens* 74747 (SEQ ID NO: 22), *T. atroviride* 147450 (SEQ ID NO: 23), *F. graminicola* XP_386703.1 (SEQ ID NO: 24), *A. nidulans* CBF75094.1 (SEQ ID NO: 25), *A.niger* EHA21022.1 (SEQ ID NO: 26), *A. oryzae* XP_001727175.1 (SEQ ID NO: 27), *A.fumigatus* XP_749158.1 (SEQ ID NO: 28), *M. thermophila* XP_003667354.1 (SEQ ID NO: 29), *F.graminicola* XP_385112.1 (SEQ ID NO: 30), *P. Chrysogenum* XP_002567159.1 (SEQ ID NO: 31), *A. fumigatus* XP_748386.2 (SEQ ID NO: 32), *A. oryzae* XP_001819545.1 (SEQ ID NO: 33), *A. nidulans* XP_681714.1 (SEQ ID NO: 34), *N. crassa* XP_957507.1 (SEQ ID NO: 35), *M. thermophila* XP_003665703.1 (SEQ ID NO: 36), and homologs thereof.

Accordingly, in certain embodiments, a amp1 protease has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more to an amino acid sequence selected from SEQ ID NOs: 21-36. In some embodiments, the protease has 100% identity to an amino acid sequence selected from SEQ ID NOs: 21-36.

In some embodiments, amp1 is *T. reesei* amp1. The amino acid sequence encoded by *T. reesei* amp1 is set forth in SEQ ID NO: 21. In other embodiments, a protease of the present disclosure has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 21. In further embodiments, the protease has 100% identity to SEQ ID NO: 21.

Examples of suitable amp2 proteases include, without limitation, *Trichoderma reesei* amp2 108592 (SEQ ID NO: 37), *T. virens* 73611(SEQ ID NO: 38), *T. atroviride* 284076 (SEQ ID NO: 39), *F. graminicola* XP_390364.1 (SEQ ID NO: 40), *N. crassa* XP_960660.1 (SEQ ID NO: 41), *M. thermophila* XP_003662184.1 (SEQ ID NO: 42), *A. oryzae* XP_001826499.2 (SEQ ID NO: 43), *A. niger* XP_001390581.1 (SEQ ID NO: 44), *A. nidulans* XP_663416.1 (SEQ ID NO: 45), *A. fumigatus* XP_755088.1 (SEQ ID NO: 46), *P. chrysogenum* XP_002558974.1 (SEQ ID NO: 47) and homologs thereof.

Accordingly, in certain embodiments, a amp2 protease has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more to an amino acid sequence selected from SEQ ID NOs: 37-47. In some embodiments, the protease has 100% identity to an amino acid sequence selected from SEQ ID NOs: 37-47.

In some embodiments, amp2 is *T. reesei* amp2. The amino acid sequence encoded by *T. reesei* amp2 is set forth in SEQ ID NO: 37. In other embodiments, a protease of the present disclosure has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 37. In further embodiments, the protease has 100% identity to SEQ ID NO: 37.

Sep Proteases

Sep proteases are serine proteases belonging to the S28 subtype. They have a catalytic triad of serine, aspartate, and histidine: serine acts as a nucleophile, aspartate as an electrophile, and histidine as a base. These serine proteases include several eukaryotic enzymes such as lysosomal Pro-X carboxypeptidase, dipeptidyl-peptidase II, and thymus-specific serine peptidase.

Examples of suitable sep1 proteases include, without limitation, *Trichoderma reesei* sep1 124051 (SEQ ID NO: 48), *T. virens* 39211 (SEQ ID NO: 49), *T. atroviride* 296922 (SEQ ID NO: 50), *A. niger* CAK45422.1 (SEQ ID NO: 51), *A. fumigatus* EDP53789.1 (SEQ ID NO: 52), *N. crassa* XP_958301.1 (SEQ ID NO: 53), *M. thermophila* XP_003664601.1 (SEQ ID NO: 54), *M. graminicola* XP_384993.1 (SEQ ID NO: 55), *M. thermophila* XP_003658945.1 (SEQ ID NO: 56), *F. graminicola* XP_382380.1 (SEQ ID NO: 57), *A. niger* XP_001395660.1 (SEQ ID NO: 58), *M. thermophila* XP_003659734.1 (SEQ ID NO: 59), *N. crassa* XP_964374.1 (SEQ ID NO: 60), *A. fumigatus* XP_756068.1 (SEQ ID NO: 61), *A. oryzae* EIT77098.1 (SEQ ID NO: 62), *P. chrysogenum* XP_002560028.1 (SEQ ID NO: 63), *A. oryzae* EIT71569.1 (SEQ ID NO: 64), *A. nidulans* CBF79006.1 (SEQ ID NO: 65), *A. niger* XP_001400740.2 (SEQ ID NO: 66), *A. oryzae* BAE57999.1 (SEQ ID NO: 67), and homologs thereof.

Accordingly, in certain embodiments, a protease of the present disclosure, typically a sep1 protease, has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more to an amino acid sequence selected from SEQ ID NOs: 48-67. In some embodiments, the protease has 100% identity to an amino acid sequence selected from SEQ ID NOs: 48-67.

In some embodiments, sep1 is *T. reesei* sep1. The amino acid sequence encoded by *T. reesei* sep1 is set forth in SEQ ID NO: 48. In other embodiments, a protease of the present disclosure has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 48. In further embodiments, the protease has 100% identity to SEQ ID NO: 48.

Sedolisin Proteases

Sedolisin proteases are enzymes that use a serine residue for hydrolysis of the peptide bonds in polypeptides and proteins. Sedolisin proteases generally contain a unique catalytic triad of serine, glutamate, and aspartate. Sedolisin proteases also contain an aspartate residue in the oxyanion hole. Sedolisin proteases from eukaryotic organisms such as Trichoderma fungi include tripeptidyl peptidase.

Examples of suitable tpp1 proteases include, without limitation, *Trichoderma reesei* tpp1 tre82623 (SEQ ID NO: 68) and homologs thereof. Examples of homologs of tpp1 proteases identified in other organisms are described in WO2013/102674.

Homologs of Proteases

As used in reference to protease, the term "homolog" refers to a protein which has protease activity and exhibit sequence similarity with a known (reference) protease sequence. Homologs may be identified by any method known in the art, preferably, by using the BLAST tool to compare a reference sequence to a single second sequence or fragment of a sequence or to a database of sequences. As described in the "Definitions" section, BLAST will compare sequences based upon percent identity and similarity.

Preferably, a homologous protease has at least 30% identity with (optionally 30%, 40%, 45%, 50%, 55%, 60%, 65%, 70%, 75%, 80%, 85%, 90%, 95%, 99% or 100% identity over a specified region, or, when not specified, over the entire sequence), when compared to one of the protease sequences listed above, including *T. reesei* pep1, pep2, pep3, pep4, pep5, pep7, pep8, pep9, pep11, pep12, tsp1, slp1, slp2, slp3, slp5, slp6, slp7, slp8, tpp1, gap1 and gap2. Corresponding homologous proteases from *N. crassa* and *M. thermophila* are shown in SEQ ID NOs: 69-102.

Reducing the Activity of Proteases

The filamentous fungal cells according to the invention preferably have reduced or no activity of at least one endogenous protease, typically 2, 3, 4, 5 or more, in order to improve the stability and production of the glycoprotein with mammalian-like N-glycans in said filamentous fungal cell, preferably in a *Trichoderma* cell. In a specific embodiment, the total protease activity of the filamentous fungal cell of the invention is reduced to 40%, preferably 6%, or less, of the total protease activity of the corresponding parental filamentous fungal cell in which the proteases do not have the reduced activity.

Total protease activity can be measured according to standard methods in the art and, for example, as described in WO2013/102674 using protease assay kit (QuantiCleave protease assay kit, Pierce #23263) with succinylated casein as substrate.

The activity of proteases found in filamentous fungal cells can be reduced by any method known to those of skill in the art.

Reduced activity of proteases is achieved by modifying the gene encoding the protease. Examples of such modifications include, without limitation, a mutation, such as a deletion or disruption of the gene encoding said endogenous protease activity.

Accordingly, the filamentous fungal cell of the invention, such as a *Trichoderma* cell, may have one or more mutations that reduces or eliminates at least one or more endogenous protease activity compared to a parental filamentous fungal cell which does not have said protease deficient mutation(s).

Deletion or disruption mutation includes without limitation knock-out mutation, a truncation mutation, a point mutation, a missense mutation, a substitution mutation, a frameshift mutation, an insertion mutation, a duplication mutation, an amplification mutation, a translocation mutation, or an inversion mutation, and that results in a reduction or inactivation in the corresponding protease activity. Methods of generating at least one mutation in a protease encoding gene of interest are well known in the art and include, without limitation, random mutagenesis and screening, site-directed mutagenesis, PCR mutagenesis, insertional mutagenesis, chemical mutagenesis, and irradiation.

In certain embodiments, a portion of the protease encoding gene is modified, such as the region encoding the catalytic domain, the coding region, or a control sequence required for expression of the coding region. Such a control sequence of the gene may be a promoter sequence or a functional part thereof, i.e., a part that is sufficient for affecting expression of the gene. For example, a promoter sequence may be inactivated resulting in no expression or a weaker promoter may be substituted for the native promoter sequence to reduce expression of the coding sequence. Other control sequences for possible modification include, without limitation, a leader sequence, a propeptide sequence, a signal sequence, a transcription terminator, and a transcriptional activator.

Protease encoding genes that are present in filamentous fungal cells may also be modified by utilizing gene deletion techniques to eliminate or reduce expression of the gene. Gene deletion techniques enable the partial or complete removal of the gene thereby eliminating their expression. In such methods, deletion of the gene may be accomplished by homologous recombination using a plasmid that has been constructed to contiguously contain the 5' and 3' regions flanking the gene.

The protease encoding genes that are present in filamentous fungal cells may also be modified by introducing, substituting, and/or removing one or more nucleotides in the gene, or a control sequence thereof required for the transcription or translation of the gene. For example, nucleotides may be inserted or removed for the introduction of a stop codon, the removal of the start codon, or a frame-shift of the open reading frame. Such a modification may be accomplished by methods known in the art, including without limitation, site-directed mutagenesis and peR generated mutagenesis (see, for example, Botstein and Shortie, 1985, Science 229: 4719; Lo et al., 1985, Proceedings of the National Academy of Sciences USA 81: 2285; Higuchi et al., 1988, Nucleic Acids Research 16: 7351; Shimada, 1996, Meth. Mol. Bioi. 57: 157; Ho et al., 1989, Gene 77: 61; Horton et al., 1989, Gene 77: 61; and Sarkar and Sommer, 1990, BioTechniques 8: 404).

Additionally, protease encoding genes that are present in filamentous fungal cells may be modified by gene disruption techniques by inserting into the gene a disruptive nucleic acid construct containing a nucleic acid fragment homologous to the gene that will create a duplication of the region of homology and incorporate construct nucleic acid between the duplicated regions. Such a gene disruption can eliminate gene expression if the inserted construct separates the promoter of the gene from the coding region or interrupts the coding sequence such that a nonfunctional gene product results. A disrupting construct may be simply a selectable marker gene accompanied by 5' and 3' regions homologous to the gene. The selectable marker enables identification of transformants containing the disrupted gene.

Protease encoding genes that are present in filamentous fungal cells may also be modified by the process of gene conversion (see, for example, Iglesias and Trautner, 1983, Molecular General Genetics 189:5 73-76). For example, in the gene conversion a nucleotide sequence corresponding to the gene is mutagenized in vitro to produce a defective nucleotide sequence, which is then transformed into a Trichoderma strain to produce a defective gene. By homologous recombination, the defective nucleotide sequence replaces the endogenous gene. It may be desirable that the defective nucleotide sequence also contains a marker for selection of transformants containing the defective gene.

Further protease encoding genes of the present disclosure that are present in filamentous fungal cells that express a recombinant polypeptide may be modified by established anti-sense techniques using a nucleotide sequence complementary to the nucleotide sequence of the gene (see, for example, Parish and Stoker, 1997, FEMS Microbiology Letters 154: 151-157). In particular, expression of the gene by filamentous fungal cells may be reduced or inactivated by introducing a nucleotide sequence complementary to the nucleotide sequence of the gene, which may be transcribed in the strain and is capable of hybridizing to the mRNA produced in the cells. Under conditions allowing the complementary anti-sense nucleotide sequence to hybridize to the mRNA, the amount of protein translated is thus reduced or eliminated.

Protease encoding genes that are present in filamentous fungal cells may also be modified by random or specific mutagenesis using methods well known in the art, including without limitation, chemical mutagenesis (see, for example, Hopwood, The Isolation of Mutants in Methods in Microbiology (J. R. Norris and D. W. Ribbons, eds.) pp. 363-433, Academic Press, New York, 25 1970). Modification of the gene may be performed by subjecting filamentous fungal cells to mutagenesis and screening for mutant cells in which expression of the gene has been reduced or inactivated. The mutagenesis, which may be specific or random, may be performed, for example, by use of a suitable physical or chemical mutagenizing agent, use of a suitable oligonucleotide, subjecting the DNA sequence to peR generated mutagenesis, or any combination thereof. Examples of physical and chemical mutagenizing agents include, without limitation, ultraviolet (UV) irradiation, hydroxylamine, N-methyl-N'-nitro-N-nitrosoguanidine (MNNG), N-methyl-N'-nitrosogaunidine (NTG) O-methyl hydroxylamine, nitrous acid, ethyl methane sulphonate (EMS), sodium bisulphite, formic acid, and nucleotide analogues. When such agents are used, the mutagenesis is typically performed by incubating the filamentous fungal cells, such as Trichoderma cells, to be mutagenized in the presence of the mutagenizing agent of choice under suitable conditions, and then selecting for mutants exhibiting reduced or no expression of the gene.

In certain embodiments, the at least one mutation or modification in a protease encoding gene of the present disclosure results in a modified protease that has no detectable protease activity. In other embodiments, the at least one modification in a protease encoding gene of the present disclosure results in a modified protease that has at least 25% less, at least 50% less, at least 75% less, at least 90%, at least 95%, or a higher percentage less protease activity compared to a corresponding non-modified protease.

The filamentous fungal cells or Trichoderma fungal cells of the present disclosure may have reduced or no detectable protease activity of at least three, or at least four proteases selected from the group consisting of pep1, pep2, pep3, pep4, pep5, pep8, pep9, pep11, pep12, tsp1, slp1, slp2, slp3, slp5, slp6, slp7, gap1 and gap2, amp1, amp2 and sep1 in Trichoderma or corresponding homologuous proteases in other filamentous fungal species. In preferred embodiment, a filamentous fungal cell according to the invention is a filamentous fungal cell which has a deletion or disruption in at least 3 or 4 endogenous proteases, resulting in no detectable activity for such deleted or disrupted endogenous proteases.

In certain embodiments, the filamentous fungal cell or Trichoderma cell, has reduced or no detectable protease activity in pep1, tsp1, and slp1 in Trichoderma or corresponding homologuous proteases in other filamentous fungal species. In other embodiments, the filamentous fungal cell or Trichoderma cell, has reduced or no detectable protease activity in gap1, slp1, and pep1 in Trichoderma or corresponding homologuous proteases in other filamentous fungal species. In certain embodiments, the filamentous fungal cell or Trichoderma cell, has reduced or no detectable protease activity in slp2, pep1 and gap1 in Trichoderma or corresponding homologuous proteases in other filamentous fungal species. In certain embodiments, the filamentous fungal cell or Trichoderma cell, has reduced or no detectable protease activity in slp2, pep1, gap1 and pep4 in Trichoderma or corresponding homologuous proteases in other filamentous fungal species. In certain embodiments, the filamentous fungal cell or Trichoderma cell, has reduced or no detectable protease activity in slp2, pep1, gap1, pep4 and slp1 in Trichoderma or corresponding homologuous proteases in other filamentous fungal species. In certain embodiments, the filamentous fungal cell or Trichoderma cell, has reduced or no detectable protease activity in slp2, pep1, gap1, pep4, slp1, and slp3 in Trichoderma or corresponding homologuous proteases in other filamentous fungal species. In certain embodiments, the filamentous fungal cell or Trichoderma cell, has reduced or no detectable protease activity in slp2, pep1, gap1, pep4, slp1, slp3, and pep3 in Trichoderma or corresponding homologuous proteases in other filamentous fungal species. In certain embodiments, the filamentous fungal cell or Trichoderma cell, has reduced or no detectable protease activity in pep1, tsp1, slp1, gap1, gap2, pep4, and pep3 in Trichoderma or corresponding homologuous proteases in other filamentous fungal species. In certain embodiments, the filamentous fungal cell or Trichoderma cell, has reduced or no detectable protease activity in slp2, pep1, gap1, pep4, slp1, slp3, pep3 and pep2 in Trichoderma or corresponding homologuous proteases in other filamentous fungal species. In certain embodiments, the filamentous fungal cell or Trichoderma cell, has reduced or no detectable protease activity in slp2, pep1, gap1, pep4, slp1, slp3, pep3, pep2 and pep5 in Trichoderma or corresponding homologuous proteases in other filamentous fungal species. In certain embodiments, the filamentous fungal cell or Trichoderma cell, has reduced or no detectable protease activity in slp2, pep1, gap1, pep4, slp1, slp3, pep3, pep2, pep5 and tsp1 in Trichoderma or corresponding homologuous proteases in other filamentous fungal species. In certain embodiments, the filamentous fungal cell or Trichoderma cell, has reduced or no detectable protease activity in slp2, pep1, gap1, pep4, slp1, slp3, pep3, pep2, pep5, tsp1 and slp7 in Trichoderma or corresponding homologuous proteases in other filamentous fungal species. In certain embodiments, the filamentous fungal cell or Trichoderma cell, has reduced or no detectable protease activity in slp2, pep1, gap1, pep4, slp1, slp3, pep3, pep2, pep5, tsp1, slp7 and slp8 in Trichoderma or corresponding homologuous proteases in other filamentous fungal species. In certain embodiments, the filamentous fungal cell or Trichoderma cell, has reduced or no detectable protease activity in slp2, pep1, gap1, pep4, slp1, slp3, pep3, pep2, pep5, tsp1, slp7, slp8 and gap2 in Trichoderma or corresponding homologuous proteases in other filamentous fungal species. In certain embodiments, the filamentous fungal cell or Trichoderma cell, has reduced or no detectable protease activity in at least three endogenous proteases selected from the group consisting of pep1, pep2, pep3, pep4, pep5, pep8, pep9, pep11, pep12, tsp1, slp2, slp3, slp7, gap1 and gap2 in Trichoderma or corresponding homologuous proteases in other filamentous fungal species. In certain embodiments, the filamentous fungal cell or Trichoderma cell, has reduced or no detectable protease activity in at least three to six endogenous proteases selected from the group consisting of pep1, pep2, pep3, pep4, pep5, tsp1, slp1, slp2, slp3, gap1 and gap2 in Trichoderma or corresponding homologuous proteases in other filamentous fungal species. In certain embodiments, the filamentous fungal cell or Trichoderma cell, has reduced or no detectable protease activity in at least seven to ten endogenous proteases selected from the group consisting of pep1, pep2, pep3, pep4, pep5, pep7, pep8, tsp1, slp1, slp2, slp3, slp5, slp6, slp7, slp8, tpp1, gap1 and gap2 in Trichoderma or corresponding homologuous proteases in other filamentous fungal species.

Expression of Heterologous Catalytic Subunits of Oligosaccharyl Transferase in Filamentous Fungal Cells As used herein, the expression "oligosaccharyl transferase" or OST refers to the enzymatic complex that transfers a 14-sugar oligosaccharide from dolichol to nascent protein. It is a type of glycosyltransferase. The sugar Glc3Man9GlcNAc2 is attached to an asparagine (Asn) residue in the sequence Asn-X-Ser or Asn-X-Thr where X is any amino acid except proline. This sequence is called a glycosylation sequon. The reaction catalyzed by OST is the central step in the N-linked glycosylation pathway.

In most eukaryotes, OST is a hetero-oligomeric complex composed of eight different proteins, in which the STT3 component is believed to be the catalytic subunit.

According to a specific embodiment of the present invention, the heterologous catalytic subunit of oligosaccharyl transferase is selected from *Leishmania* oligosaccharyl transferase catalytic subunits. There are four STT3 paralogues in the parasitic protozoa *Leishmania,* named STT3A, STT3B, STT3C and STT3D.

In one embodiment, the heterologous catalytic subunit of oligosaccharyl transferase is STT3D from *Leishmania major* (having the amino acid sequence as set forth in SEQ ID No:103).

In another embodiment, the heterologous catalytic subunit of oligosaccharyl transferase is STT3D from *Leishmania infantum* (having the amino acid sequence as set forth in SEQ ID No:104).

In another embodiment, the heterologous catalytic subunit of oligosaccharyl transferase is STT3D from *Leishmania braziliensis* (having the amino acid sequence as set forth in SEQ ID No:105).

In another embodiment, the heterologous catalytic subunit of oligosaccharyl transferase is STT3D from *Leishmania mexicana* (having the amino acid sequence as set forth in SEQ ID No:106).

In one embodiment of the invention, the polynucleotide encoding heterologous catalytic subunit of oligosaccharyl transferase comprises SEQ ID NO:107.

SEQ ID NO:107 is a codon-optimized version of the STT3D gene from *L major* (gi389594572|XM_003722461.1).

In one embodiment of the invention, the polynucleotide encoding heterologous catalytic subunit of oligosaccharyl transferase comprises SEQ ID NO:108.

SEQ ID NO:108 is a codon-optimized version of the STT3D gene from *L major* (gi339899220|XM_003392747.1|).

In one embodiment of the invention, the polynucleotide encoding heterologous catalytic subunit of oligosaccharyl transferase comprises SEQ ID NO:109 or a variant or SEQ ID NO: 109 which has been codon-optimized for expression in filamentous fungal cells such as *Trichoderma reesei.*

In one embodiment of the invention, the polynucleotide encoding heterologous catalytic subunit of oligosaccharyl transferase comprises SEQ ID NO:110 or a variant or SEQ ID NO: 110 which has been codon-optimized for expression in filamentous fungal cells such as *Trichoderma reesei.*

In one embodiment of the invention, the polynucleotide encoding a heterologous catalytic subunit of oligosaccharyl transferase comprises a polynucleotide encoding a functional variant polypeptide of STT3D from *Leishmania major, Leishmania infantum, Leishmania braziliens* or *Leishmania mexicana* having at least 50%, preferably at least 60%, even more preferably at least 70%, 80%, 90%, 95% identity with SEQ ID NO:103, SEQ ID NO:104, SEQ ID NO: 105 or SEQ ID NO: 106.

In one embodiment of the invention, the polynucleotide encoding a heterologous catalytic subunit of oligosaccharyl transferase is under the control of a promoter for the constitutive expression of said oligosaccharyl transferase is said filamentous fungal cell.

Promoters that may be used for expression of the oligosaccharyl transferase include constitutive promoters such as gpd or cDNA1, promoters of endogenous glycosylation enzymes and glycosyltransferases such as mannosyltransferases that synthesize N-glycans in the Golgi or ER, and inducible promoters of high-yield endogenous proteins such as the cbh1 promoter.

In one embodiment of the invention, said promoter is the cDNA1 promoter from *Trichoderma reesei.*

Increasing N-glycosylation Site Occupancy in Filamentous Fungal Cells

The filamentous fungal cells according to the invention may have increased oligosaccharide transferase activity, in order to increase N-glycosylation site occupancy for example as compared to the same filamentous fungal cell which does not comprise a polynucleotide encoding said heterologous catalytic subunit of oligosaccharyl transferase.

The N-glycosylation site occupancy can be measured by standard methods in the art. See for example, Schulz and Aebi (2009) Analysis of Glycosylation Site Occupancy Reveals a Role for Ost3p and Ost6p in Site-specific N-Glycosylation Efficiency, Molecular & Cellular Proteomics, 8:357-364, or Millward et al. (2008), Effect of constant and variable domain glycosylation on pharmacokinetics of therapeutic antibodies in mice, Biologicals, 36:41-47, Forno et al. (2004) N- and O-linked carbohydrates and glycosylation site occupancy in recombinant human granulocyte-macrophage colony-stimulating factor secreted by a Chinese hamster ovary cell line, Eur. J. Biochem. 271: 907-919) or methods as described herein in the Examples.

The N-glycosylation site occupancy refers to the molar percentage (or mol %) of the heterologous glycoproteins that are N-glycosylated with respect to the total number of heterologous glycoprotein produced by the filamentous fungal cell (as described in Example 1 below).

In one embodiment of the invention, the N-glycosylation site occupancy is at least 95%, and Man3, GlcNAcMan3, ManS, GlcNAcMan5, G0, G1, G2, FG0, FG1 and/or FG2 glycoforms represent at least 90% (mol %), preferably at least 95% (mol %) of total neutral N-glycans of a heterologous glycoprotein as produced in a filamentous fungal cell of the invention.

The percentage of various glycoforms with respect to the total neutral N-glycans of the heterologous glycoprotein can be measured for example as described in WO2012/069593.

Increasing α1,2 Mannosidase Activity in Filamentous Fungal Cells

As show in Example 2, in order to dramatically increase the proportion of mammalian-like N-glycan in filamentous fungi cells, increase of α1,2 mannosidase activity may be achieved in the cell. Increase of α1,2 mannosidase activity in the cell can be detected by increase of Man5 glycoform (or downstream glycoforms in the glycosylation pathway) in a cell that overexpresses α1,2 mannosidase activity as compared to a cell which does not overexpress α1,2 mannosidase activity. This can be achieved for example by recombinant overexpression of endogenous α1,2 mannosidase of the corresponding filamentous fungal cell. For example, for *Trichoderma* cell, recombinant overexpression of *Trichoderma* gene of α1,2 mannosidase can be achieved.

Accordingly, the filamentous fungal cell of the invention may comprise a recombinant polynucleotide encoding α1,2 mannosidase activity, resulting in an increased a1,2 mannosidase activity within the cell, as compared to the same filamentous fungal cell except that it does not include said recombinant polynucleotide encoding a1,2 mannosidase activity. The filamentous fungal cell of the invention may comprise a recombinant polynucleotide for increasing α1,2 mannosidase activity. The recombinant polynucleotide encoding the α-1,2-mannosidase may enable the increase of endogenous α-1,2 mannosidase activity in the host cell, or it may comprise a polynucleotide encoding α-1,2 mannosidase catalytic domain that is heterologous to the host cell. The α-1,2-mannosidase may be a mannosidase I type enzyme belonging to the glycoside hydrolase family 47 (cazy.org/GH47_all.html). In certain embodiments the α-1, 2-mannosidase is an enzyme listed at cazy.org/GH47_characterized.html. In particular, the α-1,2-mannosidase may be an ER-type enzyme that cleaves glycoproteins such as enzymes in the subfamily of ER α-mannosidase I EC 3.2.1.113 enzymes. Examples of such enzymes include human α-2-mannosidase 1B (AAC26169), a combination of mammalian ER mannosidases, or a filamentous fungal enzyme such as α-1,2-mannosidase (MDS1) (*T. reesei* AAF34579; Maras M et al J Biotech. 77, 2000, 255, or Trire 45717), α-1,2-mannosidase from *T. virens* (SEQ ID NO: 111) or from *T. atroviride* (SEQ ID NO: 112) or from *T. harzianum* (GenBank accession no. KKO97554).

In an embodiment α1,2-mannosidase activity is a microalgae α1,2-mannosidase activity. In an embodiment, the microalgae α1,2-mannosidase activity (or an α1,2 mannosidase encoding gene) is selected from the group consisting of *Chlamydomonas, Volvox, Ostreococcus, Micromonas, Coccomyxa, Chlorella, Cyanidioschyzon, Phaeodactylum, Thalassiosira, Fragilariopsis, Aureococcus, Emiliania,* and *Guillardia* α1,2-mannosidase activity.

In an embodiment α1,2-mannosidase activity is a microalgae α1,2-mannosidase activity. In an embodiment, the microalgae α1,2-mannosidase activity (or an α1,2 mannosidase encoding gene) is selected from the group consisting of *Chlamydomonas reinharditii* α1,2-mannosidase (GenBank accession no. XP_001700094, SEQ ID NO:739), *Volvox carteri f. nagariensis* α1,2-mannosidase (GenBank accession no. XP_002957696, SEQ ID NO:740), *Ostreococcus lucimarinus* α1,2-mannosidase (GenBank accession no. XP_001421581, SEQ ID NO:741), *Ostreococcus tauri* α1,2-mannosidase (GenBank accession no. XP_003083553.1, SEQ ID NO:742), *Micromonas* spRCC299 α1,2-mannosidase (Gen Bank accession no. XP_002505356.1, SEQ ID NO:743), *Micromonas pusilla* α1,2-mannosidase (GenBank accession no. XP_003058165.1, SEQ ID NO:744), *Micromonas pusilla* α1,2-mannosidase (GenBank accession no. XP_003060259.1, SEQ ID NO:745), *Coccomyxa subellipsoidea* C-169 α1,2-mannosidase (GenBank accession no. XP_005648743.1, SEQ ID NO:746), *Chlorella variabilis* NC64A α1,2-mannosidase (GenBank accession no. XP_005852238.1, SEQ ID NO:747), *Cyanidioschyzon merolae* α1,2-mannosidase (Gen Bank accession no. XP_005535714.1, SEQ ID NO:748), *Phaeodactylum tricornutum* α1,2-mannosidase (GenBank accession no. XP_002176357.1, SEQ ID NO:749), *Thalassiosira pseudonana* α1,2-mannosidase (GenBank accession no. XP_002289677.1, SEQ ID NO:750), *Thalassiosira pseudonana* α1,2-mannosidase (GenBank accession no. XP_002291430.1, SEQ ID NO:751), *Thalassiosira pseudonana* α1,2-mannosidase (GenBank accession no. XP_002289678.1, SEQ ID NO:752), *Fragilariopsis cylindrus* JGI ProteinId: 168118 (, SEQ ID NO:753), *Fragilariopsis cylindrus* JGI ProteinId: 261302 (, SEQ ID NO:754), *Aureococcus anophagereffens* α1,2-mannosidase (GenBank accession no. EGB10338.1, SEQ ID NO:755), *Aureococcus anophagereffens* α1,2-mannosidase (GenBank accession no. EGB09525.1, SEQ ID NO:756), *Emiliania huxley* α1,2-mannosidase (GenBank accession no. XP_005786216.1, SEQ ID NO:757), *Emiliania huxley* α1,2-mannosidase (GenBank accession no. XP_005777157.1, SEQ ID NO:758), *Emiliania huxley* α1,2-mannosidase (GenBank accession no. EOD18227.1, SEQ ID NO:759), *Emiliania huxley* α1,2-mannosidase (GenBank accession no. XP_005771219.1, SEQ ID NO:760), *Guillardia theta* α1,2-mannosidase (GenBank accession no. XP_005835818.1, SEQ ID NO:761), and *Guillardia theta* α1,2-mannosidase (GenBank accession no. XP_005827979.1, SEQ ID NO:762).

For ER expression, the catalytic domain of the mannosidase is typically fused with a targeting peptide, such as HDEL, KDEL, or part of an ER or early Golgi protein, or expressed with an endogenous ER targeting structures of an animal or plant mannosidase I enzyme.

In one specific embodiment, the filamentous fungal cell is *Trichoderma* cell and HDEL targeting signal is used as a C-terminal fusion with *Trichoderma* α1,2 mannosidase catalytic domain.

In a specific embodiment of the present invention, said filamentous fungal is a *Trichoderma* cell, which comprises one or more mutations that reduces or eliminates one or more endogenous protease activity compared to a parental filamentous fungal cell which does not have said mutation(s), reduced α1,6 mannosyltransferase activity by deletion of och1 gene, and overexpression of endogenous *Trichoderma* α1,2 mannosidase activity. In such specific embodiment, overexpression can be obtained by use of promoters like pTEF, pCDNA, pGPDA, pActin, pTubulin or other strongly expressed promoter. Preferably, in a *Trichoderma reesei* cell, the coding sequences of *T. reesei* α1,2 mannosidase of SEQ ID NOs:113 and 114 are used.

In a specific embodiment of the present invention, said filamentous fungal is a *Trichoderma* cell, which comprises one or more mutations that reduces or eliminates one or more endogenous protease activity compared to a parental filamentous fungal cell which does not have said mutation(s) and overexpression of microalgae α1,2 mannosidase activity, for example, *Phaeodactylum tricornutum* α1,2-mannosidase.

In a specific embodiment of the present invention, said filamentous fungal is a *Trichoderma* cell, which comprises one or more mutations that reduces or eliminates one or more endogenous protease activity compared to a parental filamentous fungal cell which does not have said mutation(s), reduced α1,6 mannosyltransferase activity by deletion of och11 gene, and overexpression of microalgae α1,2 mannosidase activity, for example, *Phaeodactylum tricornutum* α1,2-mannosidase.

Reducing Endogenous O-mannosyltransferase Activity

In specific embodiments, the filamentous fungal cell of the invention has reduced or no endogenous O-mannosyltransferase activity, in order to reduce or suppress undesirable O-mannosylation on produced heterologous glycoprotein. Accordingly, the filamentous fungal cell of the invention, for example, a *Trichoderma* cell, may comprise at least one mutation or a deletion in a PMT gene that reduces endogenous O-mannosyltransferase activity compared to a parental filamentous fungal cell which does not have said mutation.

O-mannosyltransferases are encoded by pmt genes in yeasts and filamentous fungi, which can be divided into three subfamilies, based on sequence homologies: PMT1, PMT2 and PMT4.

For example, in yeast *S. cerevisiae,* 7 different PMTs have been characterized: ScPMT1, ScPMT5 and ScPMT7 belong to the PMT1 subfamily. ScPMT2, ScPMT3 and ScPMT6 belong to the PMT2 subfamily and ScPMT4 belongs to the PMT4 subfamily. Such O-mannosyltransferases and their coding sequences may be identified and isolated from filamentous fungal cells and tested to determine whether reduction in their activity enables the reduction of O-mannosylation on secreted O-mannosylated recombinant protein preferably not affecting the production of such recombinant polypeptide from the filamentous fungal cell. Methods for identifying and isolating PMTs are well known in the art. An identified O-mannosyltransferase may then be tested by deleting the gene encoding the identified O-mannosyltransferase from a filamentous fungal cell that expresses a recombinant O-mannosylated protein, such a heterologous or mammalian O-mannosylated protein, and determining whether the deletion results in a decrease in total O-mannosyltransferase activity of the cell, preferably not affecting the level of production of the expressed recombinant protein. Methods for deleting genes and measuring levels of produced protein are well known in the art and include the methods described herein.

Three O-mannosyltransferases have been identified in Trichoderma fungal cells: pmt1, pmt2 and pmt3, belonging respectively based on sequence homologies to the PMT4, PMT1 and PMT2 subfamily.

Examples of suitable O-mannosyltransferase include, without limitation, *Trichoderma reesei* pmt1 (SEQ ID NO:115), *Trichoderma reesei* pmt2 (SEQ ID NO: 116), *Trichoderma reesei* pmt3 (SEQ ID NO: 117) and homologs thereof.

In a preferred embodiment, said PMT-deficient filamentous fungal cell, e.g., a *Trichoderma* cell, has at least one mutation in a PMT gene selected from the group consisting of:
a) PMT1 gene comprising the polynucleotide of SEQ ID NO:118,
b) a functional homologous gene of PMT1 gene, which functional homologous gene is capable of restoring parental O-mannosylation level by functional complementation when introduced into a *T. reesei* strain having a disruption in said PMT1 gene, and,
c) a polynucleotide encoding a polypeptide having at least 50%, at least 60%, at least 70%, at least 90%, or at least 95% identity with SEQ ID NO:115, said polypeptide having protein O-mannosyltransferase activity.

More preferably, said PMT-deficient filamentous fungal cell, e.g., a *Trichoderma* cell, has at least one mutation in a PMT gene which
a) has a polynucleotide encoding a polypeptide having at least 50%, at least 60%, at least 70%, at least 90%, or at least 95% identity with SEQ ID NO:115, and,
b) is capable of restoring, at least 50%, preferably about 100% of parental O-mannosylation level by functional complementation when introduced into a *T. reesei* strain having a disruption in a *T. reesei* PMT1 gene.

Sequences of homologs of pmt1 in filamentous fungi can be found in the databases using sequence alignment search tools, such as BLAST algorithm. It includes without limitation, *A. oryzae* gi391865791, EIT75070.1 (SEQ ID NO:119), *A. niger* gi317036343, XP_001398147.2 (SEQ ID NO:120), *A. nidulans* gi67522004, XP_659063.1 (SEQ ID NO:121), *T. virens* gi358379774, EHK17453.1 (SEQ ID NO:122), *T. atroviride* gi358400594, EHK49920.1 (SEQ ID NO:123), *F. oxysporum* gi342879728, EGU80965.1 (SEQ ID NO:124), *G. zeae* gi46107450, XP_380784.1 (SEQ ID NO:125), *M. thermophila* gi367020262, XP_003659416.1 (SEQ ID NO:126), *N. crassa* gi164423013, XP_963926.2 (SEQ ID NO:127), and *P. chrysogenum* gi255953619, XP_002567562.1 (SEQ ID NO:128).

The PMT-deficient filamentous fungal cells according to specific embodiments of the invention have reduced activity of at least one O-mannosyltransferase activity, in order to reduce or decrease O-mannosylation in said filamentous fungal cell, preferably *Trichoderma* cell.

The activity of said O-mannosyltransferases found in filamentous fungal cells can be reduced by any method known to those of skill in the art. In some embodiments reduced activity of O-mannosyltransferases is achieved by reducing the expression of the O-mannosyltransferases, for example, by promoter modification or RNAi.

In other embodiments, reduced activity of O-mannosyltransferases is achieved by modifying the gene encoding the O-mannosyltransferase. Examples of such modifications include, without limitation, a mutation, such as a deletion or disruption of the gene encoding said endogenous O-mannosyltransferase activity.

Deletion or disruption mutation can be performed as described in the above sections, in particular in relation to deletion or disruption of genes encoding proteases. These includes without limitation knock-out mutation, a truncation mutation, a point mutation, a missense mutation, a substitution mutation, a frameshift mutation, an insertion mutation, a duplication mutation, an amplification mutation, a translocation mutation, or an inversion mutation, and that results in a reduction in the corresponding O-mannosyltransferase activity.

In certain embodiments, the mutation or modification in an O-mannosyltransferase (PMT) encoding gene of the present disclosure results in a modified O-mannosyltransferase that has no detectable O-mannosyltransferase activity. In other embodiments, the at least one modification in a O-mannosyltransferase encoding gene of the present disclosure results in a modified O-mannosyltransferase that has at least 25% less, at least 50% less, at least 75% less, at least 90%, at least 95%, or a higher percentage less O-mannosyltransferase activity compared to a corresponding non-modified O-mannosyltransferase.

In preferred embodiment, a mutation that reduces endogenous protein O-mannosyltransferase activity in a filamentous fungal cell, e.g. *Trichoderma* cell, is a PMT-deficient cell which has a deletion or disruption of a PMT gene encoding said O-mannosyltransferase activity, resulting in no detectable expression for such deleted or disrupted PMT gene.

One specific embodiment of the present invention is a PMT-deficient *Trichoderma reesei* cell, comprising
a. at least a first mutation that reduces an endogenous protease activity compared to a parental *Trichoderma* cell which does not have said first mutation, and,
b. at least a disruption or deletion of PMT1 gene of *T. reesei*.

said cell further expressing a heterologous glycoprotein with serine or threonine, which has reduced O-mannosylation due to said mutation in said PMT gene.

The reduction (or decrease) of O-mannosyltransferase activity may be determined by comparing the O-mannosylation level of a heterologous protein in PMT-deficient filamentous fungal cell according to the invention, with the O-mannosylation level of a heterologous protein in the parental cell which does not have said PMT-deficient mutation.

In specific embodiments, the PMT-deficient filamentous fungal cell according to the invention expresses a heterologous glycoprotein which has reduced O-mannosylation due to said mutation in said PMT gene and the O-mannosylation level on the expressed heterologous protein is at least 20%, 40%, 50%, 60%, 70%, 80%, or 90% lower than the O-mannosylation level of the heterologous protein when expressed in the parental filamentous fungal cell which does not have said second PMT-deficient mutation.

O-mannosylation level may also be determined as mole % of O-mannosylated polypeptide per total polypeptide as produced by the host cell of the invention. Analytical methods, such as MALDI TOF MS analysis may be used to determine O-mannosylation level as described in detail in the Example 1 below, section entitled "Analyses of Dpmt1 strains M403, M404, M406 and M407. In brief, a polypeptide as produced by the PMT-deficient filamentous fungal cell is purified to determine its O-mannoslyation level. Non O-mannosylated, and O-mannosylated structure of the polypeptide are separated and quantified by MALDI-TOF MS analysis. For example, the quantification of O-mannosylation level may be performed by determining area values or intensity of the different peaks of MALDI-TOF MS spectrum. An O-mannosylation level of 5% as determined by such method, using area values or intensity, reflects that about 95% (mol %) of the analysed polypeptides in the composition are not O-mannosylatedIn specific embodiments, the PMT-deficient filamentous fungal cell expresses a heterologous protein which has reduced O-mannosylation due to said mutation in said PMT gene, and the O-mannosylation level on the expressed heterologous protein (for example, as defined above by determining area or intensity values of MALDI TOF MS spectrum peaks) is reduced to less than 25%, 20%, 17%, 15%, 13%, 12%, 11%, 10%, 9%, 8%, 7%, 6%, 5%, 4%, 3%, 2%, or 1%, or 0.5% (as mole % of mannose residues per polypeptide chain).

In an embodiment, the heterologous glycoprotein with reduced O-mannosylation is selected from the group consisting of an immunoglubulin, such as IgG.

In a specific embodiment, a mutation that reduces endogenous O-mannosyltransferase activity is a deletion or a disruption of a PMT gene encoding said engogenous protein O-mannosyltransferase activity. For example in *Trichoderma* cell, a mutation that reduces endogenous O-mannosyltransferase activity is a deletion or a disruption of a PMT1 gene.

Reducing Mannosyltransferase Activity (Och1) in Filamentous Fungal Cells

In certain embodiments, the filamentous fungal cell further has a reduced level of activity of an alpha-1,6-mannosyltransferase compared to the level of activity in a parent strain. Alpha-1,6-mannosyltransferase (EC 2.4.1.232) transfers an alpha-D-mannosyl residue from GDP-mannose into a protein-linked oligosaccharide, forming an elongation initiating alpha-(1->6)-D-mannosyl-D-mannose linkage in the Golgi apparatus. Typically, the alpha-1,6-mannosyltransferase enzyme is encoded by an och1 gene. In certain embodiments, the filamentous fungal cell has a reduced level of expression of an och1 gene compared to the level of expression in a parent filamentous fungal cell. In certain embodiments, the och1 gene is deleted from the filamentous fungal cell.

Examples of suitable OCH1 gene include, without limitation, *Trichoderma reesei* och1 encoding the polypeptide of SEQ ID NO: 129, and homologs thereof.

Sequences of homologs of och1 in filamentous fungi can be found in the databases using sequence alignment search tools, such as BLAST algorithm. It includes without limitation, *A. oryzae, T. reesei, T. virens, T. atroviride, Fusarium oxysporum, F. gaminearum, N. crassa, M. thermophila, A. fumigatus, A. niger, A. oryzae, A. nidulans, Penicillium roqueforti*, and *P. chrysogenum*. Examples of such homologs of OCH1 in other filamentous fungi species include, without limitation SEQ ID NOs:430-441.

Deletion or disruption mutation of the OCH1 can be performed as described in the above sections, in particular in relation to deletion or disruption of genes encoding proteases. These includes without limitation knock-out mutation, a truncation mutation, a point mutation, a missense mutation, a substitution mutation, a frameshift mutation, an insertion mutation, a duplication mutation, an amplification mutation, a translocation mutation, or an inversion mutation, and that results in a reduction in the corresponding reduction of mannosyltransferase activity.

In certain embodiments, the mutation or modification in an OCH1 gene of the present disclosure results in a modified mannosyltransferase enzyme that has no detectable OCH1 activity. Accordingly, in some embodiments, said filamentous fungal cell of the invention is deficient in OCH1 activity.

Reducing EndoT Activity in Filamentous Fungal Cells

In certain embodiments, the filamentous fungal cell further has a reduced level of EndoT activity compared to the level of activity in a parent strain. EndoT (EC.3.2.1.96) has mannosyl glycoprotein endo-N-acetyl-β-D-glucosaminidase (ENGase) type activity, and in *T. reesei* this endo-N-acetyl-β-D-glucosaminidase is denoted as EndoT (Stals I et al. (2010) Identification of a gene coding for a deglycosylating enzyme in Hypocrea jecorina, FEMS Microbiol Lett. 303: 9-17; doi: 10.1111/j.1574-6968.2009.01849.x and Stals I et al. (2012) High resolution crystal structure of the endo-N-Acetyl-β-D-glucosaminidase responsible for the deglycosylation of *Hypocrea jecorina* cellulases. PLoS One, 7:e40854; doi: 10.1371/journal.pone.0040854). Typically, the EndoT enzyme is encoded by an endoT gene. In certain embodiments, the filamentous fungal cell has a reduced level of expression of an endoT gene compared to the level of expression in a parent filamentous fungal cell. In certain embodiments, the endoT gene is deleted from the filamentous fungal cell.

Examples of suitable endoT gene include, without limitation, *Trichoderma reesei* endoT (SEQ ID NO: 130), and homologs thereof. Sequences of homologs of endoT in filamentous fungi can be found in the databases using sequence alignment search tools, such as BLAST algorithm. It includes without limitation, *T. virens, T. atroviride, N. crassa, F. graminearum, M. thermophile, A. nidulans, Penicillium chrysogenum, A. fumigatus, A. oryzae, A. niger, Rhizopus microspores, Rhizopus niveus,* and *Mucor circinelloides* (respectively, SEQ ID NOs 442-454).

Deletion or disruption mutation of the EndoT can be performed as described in the above sections, in particular in relation to deletion or disruption of genes encoding proteases. These includes without limitation knock-out mutation, a truncation mutation, a point mutation, a missense mutation, a substitution mutation, a frameshift mutation, an insertion mutation, a duplication mutation, an amplification mutation, a translocation mutation, or an inversion mutation, and that results in a reduction in the corresponding reduction of mannosyltransferase activity.

In certain embodiments, the mutation or modification in an EndoT gene of the present disclosure results in a modified EndoT enzyme that has no detectable EndoT activity. Accordingly, in some embodiments, said filamentous fungal cell of the invention is deficient in EndoT activity.

Increasing α-glucosidase II Activity in Filamentous Fungal Cells

In mammalian cells, N-glycosylation of proteins starts in the lumen of the endoplasmic reticulum (ER) by the en bloc transfer of the precursor glycan Glc3Man9GlcNAc2 to suitable Asn-X-Ser/THr sequons of nascent polypeptide chains. The first α1,2 linked glucose residue is removed by glucosidase I. The two remaining α1,3 glucoses are hydrolysed by glucosidase II. Glucosidase II is an asymmetric nonglobular heterodimer consisting of a catalytic alpha subunit and a beta subunit.

Glucosidase II α subunit has been disclosed in filamentous fungi species and include for example, *Trichoderma reesei* Glucosidase II α subunit (SEQ ID NO:131), *Aspergillus niger* Glucosidase II α subunit (see SEQ ID NO:457 or its optimized coding sequence with CBH1 signal sequence of SEQ ID NO:458) or *Trypanosoma congolense* Glucosidase II α subunit (see SEQ ID NO:456 or its optimized coding sequence with CBH1 signal sequence of SEQ ID NO:455). Glucosidase II α subunit has been disclosed in filamentous fungi species and include for example, *Trichoderma reesei* Glucosidase II α subunit (GenBank accession no. AAU87580), *Trichoderma reesei* Glucosidase II α subunit (GenBank accession no. ETS03029), *Trichoderma virens* Glucosidase II α subunit (GenBank accession no. EHK26032), *Trichoderma atroviride* Glucosidase II α subunit (GenBank accession no. EHK41782), and *Trichoderma harzianum* Glucosidase II α subunit (GenBank accession no. KKP06647). Glucosidase II α subunit has been disclosed in protozoa *Trypanosoma congolense* Glucosidase II α subunit (GenBank accession no. CCC94599).

Glucosidase II β-subunit may also be co-expressed together with glucosidase a-subunit. Suitable glucosidase II β subunit has been disclosed in filamentous fungi species and includes for example, *Trichoderma reesei* glucosidase II β subunit (SEQ ID NO:132 or its corresponding genomic sequence of SEQ ID NO:460), *Aspergillus niger* glucosidase II β subunit (SEQ ID NO:133 or its corresponding genomic sequence of SEQ ID NO:459). Other suitable glucosidase II β subunit includes for example, *Trichoderma virens* glucosidase II β subunit (GenBank accession no. EHK23384), *Trichoderma harzianum* glucosidase II β subunit (GenBank accession no. KKP05633), and *Trichoderma atroviride* glucosidase II β subunit (GenBank accession no. EHK43820).

In an embodiment, α glucosidase II catalytic domain sequences are microalgae α glucosidase II catalytic domain sequences. In an embodiment, the α glucosidase II catalytic domain sequences are selected from the group consisting of consisting of *Phaeodactylum, Chlamydomonas, Volvox, Ostreococcus, Micromonas, Coccomyxa, Chlorella, Cyanidioschyzon, Galdieria, Thalassiosira, Fragilariopsis, Aureococcus, Nannochloropsis, Emiliania,* and *Guillardia* α glucosidase II catalytic domain coding sequences.

In an embodiment, α glucosidase II catalytic domain sequences are microalgae α glucosidase II catalytic domain sequences. In an embodiment, α glucosidase II α subunit catalytic domain sequences are selected from the group consisting of *Phaeodactylum tricornutum* Glucosidase II α subunit (GenBank accession no. XP_002178760.1, SEQ ID NO:776), *Chlamydomonas reinhardtii* Glucosidase II α subunit (GenBank accession no. XP_001692042.1, SEQ ID NO:777), *Volvox carteri f. nagariensis* Glucosidase II α subunit (GenBank accession no. XP_002950309.1, SEQ ID NO:778), *Ostreococcus tauri* Glucosidase II α subunit (GenBank accession no. CEG01527.1, SEQ ID NO:779), *Micromonas pusilla* Glucosidase II α subunit (GenBank accession no. XP_003058660.1, SEQ ID NO:780), *Coccomyxa subellipsoidea* C-169 Glucosidase II α subunit (GenBank accession no. XP_005645495.1, SEQ ID NO:781), *Chlorella variabilis* Glucosidase II α subunit (GenBank accession no. XP_005844108.1, SEQ ID NO:782), *Cyanidioschyzon merolae* strain 10D Glucosidase II α subunit (GenBank accession no. XP_005536998.1, SEQ ID NO:783), *Galdieria sulphuraria* Glucosidase II α subunit (GenBank accession no. XP_005708660.1, SEQ ID NO:784), *Thalassiosira pseudonana* CCMP1335 Glucosidase II α subunit (GenBank accession no. XP_002296109.1, SEQ ID NO:785), *Fragilariopsis cylindrus* CCMP 1102 Glucosidase II α subunit (JGI ID:180330, SEQ ID NO:786), *Aureococcus anophagefferens* Glucosidase II α subunit (GenBank accession no. XP_009032736.1, SEQ ID NO:787), *Nannochloropsis gaditana* Glucosidase II α subunit (GenBank accession no. EWM29793.1, SEQ ID NO:788), *Emiliania huxleyi* Glucosidase II α subunit (GenBank accession no. XP_005771424.1, SEQ ID NO:789), and *Guillardia theta* CCMP2712 Glucosidase II α subunit (GenBank accession no. XP_005832665.1, SEQ ID NO:790).

In an embodiment, the α glucosidase II β subunit catalytic domain sequences are selected from the group consisting of consisting of *P. tricornutum* Glucosidase II β subunit (GenBank accession no. XP_002186069, SEQ ID NO:791), *Chlamydomonas reinhardtii* Glucosidase II β subunit (SEQ ID NO: 792), *Volvox carteri f. nagariensis* Glucosidase II β subunit (GenBank accession no. XP_002946471.1, SEQ ID NO: 793), *Ostreococcus tauri* Glucosidase II β subunit (GenBank accession no. CEG01669.1, SEQ ID NO: 794), *Micromonas* sp. RCC299 Glucosidase II β subunit (GenBank accession no. XP_002506705.1, SEQ ID NO: 795), *Micromonas pusilla* Glucosidase II β subunit (SEQ ID No: 796), *Coccomyxa subellipsoidea* C-169 Glucosidase II β subunit (GenBank accession no. XP_005645990.1, SEQ ID NO: 797), *Chlorella variabilis* Glucosidase II β subunit (GenBank accession no. XP_005843002.1, SEQ ID NO: 798), *Cyanidioschyzon merolae* strain 10D Glucosidase II β subunit (GenBank accession no. XP_005537399.1, SEQ ID NO: 799), *Galdieria sulphuraria* Glucosidase II β subunit (GenBank accession no. XP_005708309.1, SEQ ID NO: 800), *Thalassiosira pseudonana* CCMP1335 Glucosidase II β subunit (GenBank accession no. XP_002293388.1, SEQ ID NO: 801), *Thalassiosira oceanica* Glucosidase II β subunit (GenBank accession no. EJK74827.1, SEQ ID NO: 802), *Fragilariopsis cylindrus* Glucosidase II β subunit (JGI ID: 249094, SEQ ID NO: 803), *Aureococcus anophagefferens* Glucosidase II β subunit (SEQ ID NO: 804), *Nannochloropsis gaditana* Glucosidase II β subunit (GenBank accession no. EWM27035.1, SEQ ID NO: 805), *Emiliania huxleyi* CCMP1516 Glucosidase II β subunit (GenBank accession no. XP_005779661.1, SEQ ID NO: 806), and *Guillardia theta* CCMP2712 Glucosidase II β subunit (GenBank accession no. XP_005840797.1, SEQ ID NO: 807).

In some specific embodiments, in particular in filamentous fungal cells with deletion in alg3 gene as described hereafter, the cells of the invention comprise a recombinant polynucleotide for increasing α-glucosidase II activity.

Indeed, in host cells with reduced or eliminated alg3 activity, the N-glycans may be capped by glucose residues. It has been found that endogenous α-glucosidase II is not sufficient to remove glucose and it is generally required to increase α-glucosidase II activity to produce heterologous glycoprotein with predominant mammalian-like N-glycans in the filamentous fungal cells of the invention.

This can be achieved for example by recombinant overexpression of endogenous α of the corresponding filamentous fungal cell. For example, for *Trichoderma* cell, recombinant overexpression of *Trichoderma* gene of a glucosidase II can be achieved.

The polynucleotide encoding the α-glucosidase II may enable the increase of endogenous glucosidase II activity in the host cell, or it may comprise a polynucleotide for expression of α glucosidase II catalytic domain which is heterologous to the host cell.

In one specific embodiment, the invention relates to a *Trichoderma* cell, which comprises a polynucleotide for increasing endogenous *Trichoderma* α-glucosidase II activity. In a specific embodiment of the present invention, said filamentous fungal is a *Trichoderma* cell, which comprises one or mutations that reduces or eliminates one or more endogenous protease activity compared to a parental filamentous fungal cell which does not have said mutation(s), and overexpresses endogenous *Trichoderma* α-glucosidase II activity. In such specific embodiment, overexpression can be obtained by use of strong promoter for overexpression of α-glucosidase II activity, such as pCDNA or pGPDA. Preferably, in *T. reesei* cell, the following coding sequence of *T. reesei* α-glucosidase II is used for increasing α-glucosidase II activity: SEQ ID NO: 134.

Alternatively, expression of heterologous coding sequences of α-glucosidase II may be used, and more preferably, expression of at least 2 distinct genes encoding α-glucosidase II is achieved in a host cell of the invention. For example, a *Trichoderma* cell of the invention may comprises one recombinant gene overexpressing glucosidase II α-subunit of *Trichoderma reesei* and another recombinant gene for expressing *Trypanosoma congolense* glucosidase II α-subunit. Preferably, the gene encoding *T. congelense* glucosidase II α-subunit is under the control of a strong promoter, for example pcDNA promoter.

For example, a *Trichoderma* cell of the invention may comprise one recombinant gene overexpressing glucosidase II α-subunit of *Trichoderma reesei* and another recombinant gene for expressing microalgae glucosidase II α-subunit.

In another specific embodiment, a filamentous fungal cell of the invention, for example, a *Trichoderma* cell, comprises a gene encoding a subunit of *Aspergillus niger* glucosidase II and a gene encoding β subunit of *Aspergillus niger* glucosidase II.

In an embodiment, a filamentous fungal cell of the invention, for example, a *Trichoderma* cell, comprises a gene encoding α subunit of microalgae glucosidase II and a gene encoding β subunit of microalgae glucosidase II. In an embodiment, microalgae glucosidase II α subunit and β subunit are from the same microalgae species. In an embodiment, microalgae glucosidase II α subunit and β subunit are from different microalgae species. In an embodiment, the endogenous gene encoding α subunit of filamentous fungal cell of the invention, for example, a *Trichoderma* cell, has been deleted and replaced with a heterogenous gene encoding, for example, α subunit of microalgae glucosidase II. In an embodiment, both the endogenous genes encoding α subunit and β subunit of glucosidase II of filamentous fungal cell of the invention, for example, a *Trichoderma* cell, have been deleted and replaced with a heterogenous genes encoding α subunit and β subunit, for example, of microalgae glucosidase II.

Modifying α-glucosidase I Activity in Filamentous Fungal Cells

In some cases it is useful to increase activity of α-glucosidase I in a filamentous fungal cell of the invention. In an embodiment, the invention relates to a *Trichoderma* cell, which comprises a polynucleotide for increasing endogenous *Trichoderma* α-glucosidase I activity. In some embodiments, α-glucosidase I activity is increased or overexpressed. In an embodiment, a polynucleotide of *T. reesei* α-glucosidase I is overexpressed in a host cell. In an embodiment, the polynucleotide is *T. reesei* α-glucosidase I (GenBank accession no. EGR49300), *Trichoderma virens* α-glucosidase I (GenBank accession no. EHK26067), *Trichoderma harzianum* α-glucosidase I (GenBank accession no. KK098075), *Trichoderma atroviride* α-glucosidase I (GenBank accession no. EHK41818), or *Aspergillus brasiliensis* α-glucosidase I (GenBank accession no. BAK64066).

In an embodiment, the polynucleotide is *Chlamydomonas reinhardtii* α-glucosidase I (JGI locus name Cre13.g579734), *Volvox carteri f.nagariensis* α-glucosidase I (JGI ID Vocar20009518m), *Coccomyxa subellipsoidea* α-glucosidase I (GenBank accession no. XP_005649525.1), *Chlorella variabilis* α-glucosidase I (GenBank accession no. XP_005849528.1), *Cyanidioschyzon merolae* α-glucosidase I (GenBank accession no. XP_005535737.1), *Galdieria sulphuraria* α-glucosidase I (GenBank accession no. XP_005706926.1), *Nannochloropsis gaditana* α-glucosidase I (GenBank accession no. EWM25850.1), or *Emiliania huxley* α-glucosidase I (GenBank accession no. XP_005759493.1).

In an embodiment, a filamentous fungal cell of the invention, for example, a *Trichoderma* cell, comprises a gene encoding microalgae α-glucosidase I, a subunit of microalgae α-glucosidase II, and a gene encoding β subunit of microalgae α-glucosidase II.

In an embodiment, the endogenous gene encoding α-glucosidase I of filamentous fungal cell of the invention, for example, a *Trichoderma* cell, has been deleted and replaced with a heterogenous gene encoding, for example, microalgae α-glucosidase I.

In an embodiment, the endogenous gene encoding α-glucosidase I of filamentous fungal cell of the invention, for example, a *Trichoderma* cell, has been deleted and replaced with a heterogenous gene encoding, for example, microalgae α-glucosidase I and both the endogenous genes encoding α subunit and β subunit of α-glucosidase II have been deleted and replaced with a heterogenous genes encoding α subunit and β subunit, for example, of microalgae α-glucosidase II.

Methods for Producing Glycoproteins with Predominant Mammalian-like Glycoforms

One main objective of the present invention is the provision of methods for producing heterologous glycoprotein, such as antibody, with predominant mammalian-like N-glycans.

As used herein, the term "predominant mammalian-like N-glycans" means that at least 90% (mol %), preferably at least 95% of the total neutral N-glycans of the produced heterologous glycoprotein are from the group consisting of:

Manα3[Manα6(Manα3)Manα6]
    Manβ4GlcNAβ4GlcNAc (Man5 glycoform);
GlcNAcβ2Manα3[Manα6(Manα3)Manα6]
    Manβ4GlcNAβ4GlcNAc (GlcNAcMan5 glycoform);
Manα6(Manα3)Manβ4GlcNAβ4GlcNAc (Man3 glycoform);
Manα6(GlcNAcβ2Manα3)Manβ4GlcNAβ4GlcNAc (GlcNAcMan3 glycoform);
complex type N-glycans selected from the G0, G1, or G2 glycoform; and,
complex type fucosylated N-glycans FG0, FG1, or FG2 glycoform.

To achieve the above objective, the host cells of the present invention preferably have all in common at least the following features:

i. one or more mutations that reduces or eliminates one or more endogenous protease activity compared to a parental filamentous fungal cell which does not have said mutation(s);

ii. a polynucleotide encoding a heterologous catalytic subunit of oligosaccharyl transferase;
iii. optionally, a recombinant polynucleotide for increasing α1, 2 mannosidase activity; and,
iv. a recombinant polynucleotide encoding said heterologous glycoprotein.

As shown in the Examples, the above characteristics are sufficient for the production of predominant Man5 glycoform in filamentous fungal cells.

In one aspect, such filamentous fungal cell is further genetically modified to produce heterologous glycoproteins with, predominantly, other mammalian-like N-glycans, downstream of the mammalian glycosylation pathway.

Such other mammalian-like N-glycans, downstream of the mammalian glycosylation pathway, may be selected from the group consisting of:
i. GlcNAcβ2Manα3[Manα6(Manα3)Manα6]Manβ4GlcNAβ4GlcNAc (GlcNAcMan5 glycoform);
ii. Manα6(Manα3)Manβ4GlcNAβ4GlcNAc (Man3 glycoform);
iii. Manα6(GlcNAcβ2Manα3)Manβ4GlcNAβ4GlcNAc (GlcNAcMan3) and,
iv. complex type N-glycans selected from the G0, G1, or G2 glycoform, or their fucosylated glycoforms, FG0, FG1 and FG2.

In an embodiment, the heterologous glycoprotein with mammalian-like N-glycans, preferably produced by an alg3 knock-out strain, include glycoforms that essentially lack or are devoid of glycans Manα3[Manα6(Manα3)Manα6]Manβ4GlcNAβ4GlcNAc (Man5). In specific embodiments, the filamentous fungal cell produces heterologous glycoproteins or antibodies with, as major glycoform, the trimannosyl N-glycan structure Manα3[Manα6]Manβ4GlcNAcβ4GlcNAc. In other embodiments, the filamentous fungal cell produces glycoproteins or antibodies with, as major glycoform, the G0 N-glycan structure GlcNAcβ2Manα3[GlcNAcβ2Manα6]Manβ4GlcNAcβ4GlcNAc.

In certain embodiments, the filamentous fungal cell of the invention produces heterologous glycoprotein or antibody with a mixture of different N-glycans.

In some embodiments, Man3GlcNAc2 N-glycan (i.e. Manα3[Manα6]Manβ4GlcNAcβ4GlcNAc) represents at least 90% or at least 95% of total (mol %) neutral N-glycans of the heterologous glycoprotein or antibody, as expressed in a filamentous fungal cells of the invention.

In other embodiments, GlcNAc2Man3 N-glycan (for example G0 GlcNAcβ2Manα3[GlcNAcβ2Manα6]Manβ4GlcNAcβ4GlcNAc) represents at least 90% or at least 95% of total (mol %) neutral N-glycans of the heterologous glycoprotein or antibody, as expressed in a filamentous fungal cells of the invention.

In other embodiments, GalGlcNAc2Man3GlcNAc2 N-glycan (for example G1 N-glycan) represents at least 90% or at least 95% of total (mol %) neutral N-glycans of the heterologous glycoprotein or antibody, as expressed in a filamentous fungal cells of the invention.

In other embodiments, Gal2GlcNAc2Man3GlcNAc2 N-glycan (for example G2 N-glycan) represents at least 90% or at least 95% of total (mol %) neutral N-glycans of the heterologous glycoprotein or antibody, as expressed in a filamentous fungal cells of the invention.

In other embodiments, complex type N-glycan represents at least 90% or at least 95% of total (mol %) neutral N-glycans of the heterologous glycoprotein or antibody, as expressed in a filamentous fungal cells of the invention.

In other embodiments, hybrid type N-glycan represents at least 90% or at least 95% of total (mol %) neutral N-glycans of the heterologous glycoprotein or antibody, as expressed in a filamentous fungal cells of the invention.

In other embodiments, less than 0.5%, 0.1%, 0.05%, or less than 0.01% of the N-glycan of the heterologous glycoprotein or antibody produced by the host cell of the invention, comprises galactose. In certain embodiments, none of N-glycans comprise galactose.

The Neu5Gc and Galα- (non-reducing end terminal Galα3Galβ4GlcNAc) structures are known xenoantigenic (animal derived) modifications of antibodies which are produced in animal cells such as CHO cells. The structures may be antigenic and, thus, harmful even at low concentrations. The filamentous fungi of the present invention lack biosynthetic pathways to produce the terminal Neu5Gc and Galα-structures. In an embodiment that may be combined with the preceding embodiments less than 0.1%, 0.01%, 0.001% or 0% of the N-glycans and/or O-glycans of the glycoprotein or antibody composition comprises Neu5Gc and/or Galα-structure. In an embodiment that may be combined with the preceding embodiments, less than 0.1%, 0.01%, 0.001% or 0% of the N-glycans and/or O-glycans of the heterologous glycoprotein or antibody comprises Neu5Gc and/or Galα-structure.

The filamentous fungal cells of the present invention lack genes to produce fucosylated heterologous proteins. In an embodiment that may be combined with the preceding embodiments, less than 0.1%, 0.01%, 0.001%, or 0% of the N-glycan of the heterologous glycoprotein or antibody comprises core fucose structures.

The terminal Galβ4GlcNAc structure of N-glycan of mammalian cell produced glycans affects bioactivity of antibodies and Galβ3GlcNAc may be xenoantigen structure from plant cell produced proteins. In an embodiment that may be combined with one or more of the preceding embodiments, less than 0.1%, 0.01%, 0.001%, or 0% of N-glycan of the heterologous glycoprotein or antibody comprises terminal galactose epitopes Galβ3/4GlcNAc.

Glycation is a common post-translational modification of proteins, resulting from the chemical reaction between reducing sugars such as glucose and the primary amino groups on protein. Glycation occurs typically in neutral or slightly alkaline pH in cell cultures conditions, for example, when producing antibodies in CHO cells and analysing them (see, for example, Zhang et al. (2008) Unveiling a glycation hot spot in a recombinant humanized monoclonal antibody. Anal Chem. 80(7):2379-2390). As filamentous fungi of the present invention are typically cultured in acidic pH, occurrence of glycation is reduced. In an embodiment that may be combined with the preceding embodiments, less than 1.0%, 0.5%, 0.1%, 0.01%, 0.001%, or 0% of the heterologous glycoprotein or antibody comprises glycation structures.

In one embodiment, the glycoprotein, such as an antibody is devoid of one, two, three, four, five, or six of the structures selected from the group of Neu5Gc, terminal Galα3Galβ4GlcNAc, terminal Galβ4GlcNAc, terminal Galβ3GlcNAc, core linked fucose and glycation structures.

In certain embodiments, such glycoprotein with predominant mammalian-like N-glycan, as produced in the filamentous fungal cell of the invention, is a therapeutic protein. Therapeutic proteins may include immunoglobulin, or a protein fusion comprising a Fc fragment or other therapeutic glycoproteins, such as antibodies, erythropoietins, interferons, growth hormones, albumins or serum albumin, enzymes, or blood-clotting factors and may be useful in the treatment of humans or animals. For example, the glycoproteins with mammalian-like N-glycan as produced by the filamentous fungal cell according to the invention may be a therapeutic glycoprotein such as rituximab.

Methods for producing glycoproteins with mammalian-like N-glycans in filamentous fungal cells are also described for example in WO2012/069593.

Genetic Engineering by Mimicking Mammalian Traditional Pathway

In one aspect, the filamentous fungal cell according to the invention as described above, is further genetically modified to mimick the traditional pathway of mammalian cells, starting from Man5 N-glycans as acceptor substrate for GnTI, and followed sequentially by GnT1, mannosidase II and GnTII reaction steps (hereafter referred as the "traditional pathway" for producing G0 glycoforms). In one variant, a single recombinant enzyme comprising the catalytic domains of GnTI and GnTII, is used.

In such embodiments for mimicking the traditional pathway for producing glycoproteins with mammalian-like N-glycans, a filamentous fungal cell expressing predominantly Man5 glycoforms with the features as described above, such as T. reesei strain, may be transformed with a GnTI or a GnTII/GnTI fusion enzyme using random integration or by targeted integration to a known site known not to affect Man5 glycosylation. Methods for expressing GnTI and/or GnTII and preferred embodiments are further described below in the next Section.

Accordingly, in a specific embodiment, the filamentous fungal cell of the invention comprises,
i. a recombinant polynucleotide for increasing α1,2 mannosidase activity, for example selected from the group consisting of: *Trichoderma* α1,2 mannosidase catalytic domain coding sequence,
ii. a polynucleotide encoding an N-acetylglucosaminetransferase I catalytic domain, preferably selected from *P. tricornutum* or *X. laevis* GnTI catalytic domain, and,
iii. a polynucleotide encoding an N-acetylglucosaminetransferase II catalytic domain.

Accordingly, in a specific embodiment, the filamentous fungal cell of the invention comprises,
i. a recombinant polynucleotide for increasing α1,2 mannosidase activity, for example selected from the group consisting of: microalgae α1,2 mannosidase catalytic domain coding sequence,
ii. a polynucleotide encoding an N-acetylglucosaminyltransferase I catalytic domain, preferably selected from *P. tricornutum, X. laevis* or microalgae GnTI catalytic domain, and,
iii. a polynucleotide encoding an N-acetylglucosaminyltransferase II catalytic domain.

Strains that synthesise GlcNAcMan5 N-glycan for production of proteins having hybrid type glycan(s) are selected.

The selected strains are further transformed for overexpressing a gene encoding a catalytic domain of a mannosidase II-type mannosidase capable of cleaving Man5 structures to generate GlcNAcMan3 for production of proteins having the corresponding GlcNAcMan3 glycoform or their derivative(s). In certain embodiments, mannosidase II-type enzymes belong to glycoside hydrolase family 38 (cazy.org/GH38_all.html). Characterized enzymes include enzymes listed in cazy.org/GH38_characterized.html. Especially useful enzymes are Golgi-type enzymes that cleaving glycoproteins, such as those of subfamily a-mannosidase II (Man2A1;ManA2). Examples of such enzymes include human enzyme AAC50302, *D. melanogaster* enzyme (Van den Elsen J. M. et al (2001) EMBO J. 20: 3008-3017), those with the 3D structure according to PDB-reference 1HTY, and others referenced with the catalytic domain in PDB. For cytoplasmic expression, the catalytic domain of the mannosidase is typically fused with an N-terminal targeting peptide (for example as disclosed in the above Section) or expressed with endogenous animal or plant Golgi targeting structures of animal or plant mannosidase II enzymes. After transformation with the catalytic domain of a mannosidase II-type mannosidase, strains are selected that produce GlcNAcMan3 (if GnTI is expressed) or strains are selected that effectively produce GlcNAc2Man3 (if a fusion of GnTI and GnTII is expressed). For strains producing GlcNAcMan3, such strains are further transformed with a polynucleotide encoding a catalytic domain of GnTII and transformant strains that are capable of producing GlcNAc$_2$Man3GlcNAc2 are selected.

In specific embodiments, the catalytic domain of *Caenorhabditis remanei* or *Culex quinquefasciatus* of α-mannosidase II is preferred. Accordingly, the invention also relates to a filamentous fungal cell comprising a coding sequence of the catalytic domain of *Caenorhabditis remanei* or *Culex quinquefasciatus* of α-mannosidase II, such as the coding sequence of SEQ ID NO:135 or SEQ ID NO:136 respectively. In specific embodiment, the catalytic domain of *Caenorhabditis briggsae* of α-mannosidase II is preferred such as GenBank accession no. XP_002636626. In specific embodiment, the catalytic domain of *Caenorhabditis brenneri* of α-mannosidase II is preferred such as GenBank accession no. EGT60275. In specific embodiment, the catalytic domain of *Caenorhabditis elegans* of α-mannosidase II is preferred such as GenBank accession no. NP_505995. In specific embodiment, the catalytic domain of Aedes aegypti of α-mannosidase II is preferred such as GenBank accession no. XP_001655799. In specific embodiment, the catalytic domain of *Anopheles gambiae* of α-mannosidase II is preferred such as GenBank accession no. XP_318477. In specific embodiment, the catalytic domain of *Anopheles sinensis* of α-mannosidase II is preferred such as GenBank accession no. KFB41315. In specific embodiment, the catalytic domain of Anopheles darling of α-mannosidase II is preferred such as GenBank accession no. ETN63703.

The following tables summarizes the essential and optional features of the filamentous fungal cell of the invention, which mimick the traditional pathway for the production G0, G1 or G2 glycoforms:

| Features | Specific embodiments in *Trichoderma* cell |
| --- | --- |
| Overexpression of α1,2 mannosidase activity | Overexpression of *T. reesei* α1,2 mannosidase catalytic domain |
| Expression of GnTI activity | Optimal expression with *P. tricornutum* or *X. laevis* catalytic domains |
| Expression of GnTII activity | Expression of human GnTII catalytic domain |
| Overexpression of α-mannosidase II activity | Optimal expression with *Caenorhabditis remanei* or *Culex quinquefasciatus* catalytic |

| Features | Specific embodiments in *Trichoderma* cell |
|---|---|
| | domains |
| Expression of β1,4 galactosyltransferase activity (optional, for galactosylated glycoforms) | |
| Expression of fucosyltransferase activity and GDP fucose synthesizing activity (optional, for fucosylated glycoforms) | Expression of human FUT8, GMD, FX and fucosyltransporter |
| Expression of STT3 (optional, for increasing n-glycosylation site occupancy, in particular for antibody production) | Expression of LmSTT3D gene |
| Elimination of α1,6 mannosyltransferase activity | Deletion of OCH1 gene |
| Reduction of O-mannosyltransferase activity | Deletion of *Trichoderma* PMT1 gene |
| Reduction of endogenous proteases activity (optional, for increasing production yield) | Deletion of pep1, tsp1, slp1, gap1, gap2, pep4, and pep3 proteases genes |
| Overexpression of α1,2 mannosidase activity | Overexpression of *T. reesei* α1,2 mannosidase catalytic domain or microalgae α1,2 mannosidase catalytic domain |
| Expression of GnTI activity | Optimal expression with *P. tricornutum* or *X. laevis* or microalgae catalytic domains |
| Expression of GnTII activity | Expression of human GnTII catalytic domain |
| Overexpression of α-mannosidase II activity | Optimal expression with *Caenorhabditis remanei* or *Culex quinquefasciatus* catalytic domains |
| Expression of β1,4 galactosyltransferase activity (optional, for galactosylated glycoforms) | |
| Expression of fucosyltransferase activity and GDP fucose synthesizing activity (optional, for fucosylated glycoforms) | Expression of human FUT8, GMD, FX and fucosyltransporter |
| Expression of STT3 (optional, for increasing n-glycosylation site occupancy, in particular for antibody production) | Expression of LmSTT3D gene |
| Elimination of α1,6 mannosyltransferase activity | Deletion of OCH1 gene |
| Reduction of O-mannosyltransferase activity | Deletion of Trichoderma PMT1 gene |
| Reduction of endogenous proteases activity (optional, for increasing production yield) | Deletion of pep1, tsp1, slp1, gap1, gap2, pep4, and pep3 proteases genes |

In such embodiment for mimicking the traditional pathway, the filamentous fungal cell is a filamentous fungal cell as defined in previous sections, and further comprising one or more polynucleotides encoding a polypeptide selected from the group consisting of:

i. N-acetylglucosaminyltransferase I catalytic domain; preferably selected from *P. tricornutum* or *X. laevis* or microalgae GnTI coding sequence;
ii. α-mannosidase II; preferably, α-mannosidase II catalytic domain of *Caenorhabditis remanei* or *Culex quinquefasciatus*;
iii. N-acetylglucosaminyltransferase II catalytic domain;
iv. optionally, β1,4 galactosyltransferase activity; and,
v. further optionally, fucosyltransferase activity and GDP fucose synthesizing activity.

Details for expressing GnTI, GnTII, galactosyltransferase and fucosylation pathway in the filamentous fungal cells of the invention are further given hereafter.

Genetic Engineering by Using the Reduced alg3 Pathway

As an alternative to the traditional pathway, the filamentous fungal cell may further be genetically modified to have alg3 reduced expression, allowing the production of core $Man_5GlcNAc_2$ and $Man_3GlcNAc_2$ N-glycans, as acceptor substrate for GnTI and GnTII subsequent reactions and bypassing the need of mannosidase II enzymes (this pathway is further called the reduced "alg3" pathway). In one variant, a single recombinant enzyme comprising the catalytic domains of GnTI and GnTII, is used.

In such embodiment using the reduced alg3 pathway, it has been found by the inventors that overexpression of a glucosidase II activity in combination of overexpression of α1,2 mannosidase activity, greatly increase the proportion of produced Man3 glycoforms thereby enabling the production of heterologous glycoproteins with predominant mammalian-like glycoforms.

In embodiments using the reduced alg3 pathway, the filamentous fungal cell, such as a *Trichoderma* cell, has a reduced level of activity of a dolichyl-P-Man:Man(5)GlcNAc(2)-PP-dolichyl mannosyltransferase compared to the level of activity in a parent host cell. Dolichyl-P-Man:Man(5)GlcNAc(2)-PP-dolichyl mannosyltransferase (EC2.4.1.130) transfers an alpha-D-mannosyl residue from dolichyl-phosphate D-mannose into a membrane lipid-linked oligosaccharide. Typically, the dolichyl-P-Man: Man(5)GlcNAc(2)-PP-dolichyl mannosyltransferase enzyme is encoded by an alg3 gene. In certain embodiments, the filamentous fungal cell for producing glycoproteins with mammalian-like N-glycans has a reduced level of expression of an alg3 gene compared to the level of expression in a parent strain.

More preferably, the filamentous fungal cell comprises a mutation of alg3. The ALG3 gene may be mutated by any means known in the art, such as point mutations or deletion of the entire alg3 gene. For example, the function of the alg3 protein is reduced or eliminated by the mutation of alg3. In certain embodiments, the alg3 gene is disrupted or deleted from the filamentous fungal cell, such as *Trichoderma* cell. In certain embodiments, the filamentous fungal cell is a *T. reesei* cell. SEQ ID NOs: 137 and 138 provide, the nucleic acid and amino acid sequences of the alg3 gene in *T. reesei*, respectively. In an embodiment the filamentous fungal cell is used for the production of a glycoprotein, wherein the glycan(s) comprise or consist of Manα3[Manα6]Manβ4GlcNAcβ4GlcNAc, and/or a non-reducing end elongated variant thereof.

The following table summarizes the essential and optional features of the filamentous fungal cell of the invention, which has reduced alg3 pathway, for the production predominant G0, G1 or G2 glycoforms (and optionally, FG0, FG1 or FG2 glycoforms):

| Feature | Specific embodiments in *Trichoderma* cell |
|---|---|
| Elimination of Dolichyl-P-Man:Man(5)GlcNAc(2)-PP-dolichyl mannosyltransferase | Deletion of ALG3 gene |
| Overexpression of α glucosidase II activity | Overexpression of *T. reesei* α glucosidase II or expression of *A. niger* and/or *T. congelense* α glucosidase II catalytic domains |
| Overexpression of α1,2 mannosidase activity | Overexpression of *T. reesei* α1,2 mannosidase catalytic domain |
| Expression of GnTI activity | Optimal expression with *P. tricornutum* or *X. laevis* catalytic domains |
| Expression of GnTII activity | Expression of human GnTII catalytic domain |
| Expression of β1,4 galactosyltransferase activity (optional, for galactosylated glycoforms) | |
| Expression of fucosyltransferase activity and GDP fucose synthesizing activity (optional, for fucosylated glycoforms) | Expression of human FUT8, GMD, FX and fucosyltransporter |
| Expression of STT3 (optional, for increasing n-glycosylation site occupancy, in particular for antibody production) | Expression of LmSTT3D gene |
| Elimination of α1,6 mannosyltransferase activity | Deletion of OCH1 gene |
| Reduction of O-mannosyltransferase activity | Deletion of *Trichoderma* PMT1 gene |
| Reduction of endogenous proteases activity (optional, for increasing production yield) | Deletion of pep1, tsp1, slp1, gap1, gap2, pep4, and pep3 proteases genes, or pep1, slp1, gap1, gap2, pep4, and pep3 proteases genes |
| Elimination of Dolichyl-P-Man:Man(5)GlcNAc(2)-PP-dolichyl mannosyltransferase | Deletion of ALG3 gene |
| Overexpression of α glucosidase II activity | Overexpression of *T. reesei* α glucosidase II or expression of *A. niger* or microalgae glucosidase II and/or *T. congelense* α glucosidase II catalytic domains |
| Overexpression of α1,2 mannosidase activity | Overexpression of *T. reesei* α1,2 mannosidase catalytic domain or overexpression of microalgae α1,2 mannosidase catalytic domain |
| Expression of GnTI activity | Optimal expression with *P. tricornutum* or *X. laevis* or microalgae catalytic domains |
| Expression of GnTII activity | Expression of human GnTII catalytic domain |
| Expression of β1,4 galactosyltransferase activity (optional, for galactosylated glycoforms) | |
| Expression of fucosyltransferase activity and GDP fucose synthesizing activity (optional, for fucosylated glycoforms) | Expression of human FUT8, GMD, FX and fucosyltransporter |
| Expression of STT3 (optional, for increasing n-glycosylation site occupancy, in particular for antibody production) | Expression of LmSTT3D gene |
| Elimination of α1,6 mannosyltransferase activity | Deletion of OCH1 gene |
| Reduction of O-mannosyltransferase activity | Deletion of *Trichoderma* PMT1 gene |
| Reduction of endogenous proteases activity (optional, for increasing production yield) | Deletion of pep1, tsp1, slp1, gap1, gap2, pep4, and pep3 proteases genes, or pep1, slp1, gap1, gap2, pep4, and pep3 proteases genes |

In such embodiment for using the reduced alg3 pathway, the filamentous fungal cell of the invention, for example, selected among *Rhizopus, Mucor, Neurospora, Trichoderma, Myceliophthora, Aspergillus, Fusarium* or *Chrysosporium* cell, and more preferably *Trichoderma*, and even more preferably *Trichoderma reesei* cell, is a filamentous fungal cell with genetic engineering as defined in previous sections, which further has a mutation in the gene encoding ALG3 that reduces or eliminates the corresponding ALG3 expression compared to the level of expression of ALG3 gene in a parental cell which does not have such mutation, and comprising a recombinant polynucleotide for increasing a glucosidase II activity, for example selected from the group consisting of *Trichoderma, Aspergillus,* or *Trypanosoma* α-glcuosidase II catalytic domain coding sequences, and which further comprises one or more polynucleotides encoding a polypeptide selected from the group consisting of:
  i. N-acetylglucosaminyltransferase I catalytic domain; preferably selected from *P. tricornutum* or *X. laevis* or microalgae GnTI coding sequence,
  ii. N-acetylglucosaminyltransferase II catalytic domain; preferably selected from human GnT II coding sequence, and,
  iii. optionally, β1,4 galactosyltransferase activity,
  iv. further optionally, fucosyltransferase activity and GDP fucose synthesizing activity.

Details for expressing GnTI, GnTII, galactosyltransferase and fucosylation pathway in the filamentous fungal cells of the invention are further given hereafter.

N-acetylglucosaminyltransferase I/II Catalytic Domain (GnTI/GnTII)

In specific embodiments, the filamentous fungal cells used in the methods of producing glycoprotein with mammalian-like N-glycans may contain a polynucleotide encoding an N-acetylglucosaminyltransferase I catalytic domain (GnTI) that catalyzes the transfer of N-acetylglucosamine to a terminal Manα3 and a polynucleotide encoding an N-acetylglucosaminyltransferase II catalytic domain (GnTII), that catalyses N-acetylglucosamine to a terminal Manα6 residue of an acceptor glycan to produce a complex N-glycan. In one embodiment, said polynucleotides encoding GnTI and GnTII are linked so as to produce a single protein fusion comprising both catalytic domains of GnTI and GnTII.

In an embodiment, the single protein fusion comprises an N-acetylglucosaminyltransferase I catalytic domain of *Phaedactylum tricornutum* N-acetylglucosaminyltransferase I and a human N-acetylglucosaminyltransferase II catalytic domain. In an embodiment, the human N-acetylglucosaminyltransferase II catalytic domain is N-terminal to the N-acetylglucosaminytransferase I catalytic domain. In an embodiment, the GnTII/GnTI fusion protein comprises (from N-terminal to C-terminal) full length human GnTII fused to *Phaedactylum tricornutum* N-acetylglucosaminyltransferase I stem and catalytic domains (from amino acid 49 onwards in *P. tricornutum* protein sequence).

As disclosed herein, N-acetylglucosaminyltransferase I (GlcNAc-TI; GnTI; EC 2.4.1.101) catalyzes the reaction UDP-N-acetyl-D-glucosamine+3-(alpha-D-mannosyl)-beta-D-mannosyl-R<=>UDP+3-(2-(N-acetyl-beta-D-glucosaminyl)-alpha-D-mannosyl)-beta-D-mannosyl-R, where R represents the remainder of the N-linked oligosaccharide in the glycan acceptor. An N-acetylglucosaminyltransferase I catalytic domain is any portion of an N-acetylglucosaminyltransferase I enzyme that is capable of catalyzing this reaction. GnTI enzymes are listed in the CAZy database in the glycosyltransferase family 13 (cazy.org/GT13_all). Enzymatically characterized species includes *A. thaliana* AAR78757.1 (U.S. Pat. No. 6,653,459), *C. elegans* AAD03023.1 (Chen S. et al J. Biol. Chem 1999; 274(1): 288-97), *D. melanogaster* AAF57454.1 (Sarkar & Schachter Biol Chem. 2001 February; 382(2):209-17); *C. griseus* AAC52872.1 (Puthalakath H. et al J. Biol. Chem 1996 271(44):27818-22); *H. sapiens* AAA52563.1 (Kumar R. et al Proc Natl Acad Sci USA. 1990 December; 87(24):9948-52); *M. auratus* AAD04130.1 (Opat As et al Biochem J. 1998 Dec. 15; 336 (Pt 3):593-8), (including an example of deactivating mutant), Rabbit, *O. cuniculus* AAA31493.1 (Sarkar M et al. Proc Natl Acad Sci USA. 1991 Jan. 1; 88(1):234-8), *Phaedactylum tricornutum* (UniProt: G0Wvt5 or XP_002182611), *Xenopus laevis* (UniProt: Q90W56, or NP_001079358), *Xenopus laevis* (GenBank accession no. AAH76770), *Xenopus laevis* (GenBank accession no. NP_001079360), *Xenopus laevis* (GenBank accession no. AAH41180), *Xenopus laevis* (GenBank accession no. NP_001165654), *Xenopus (Silurana) tropicalis* (GenBank accession no. AAH88510), *Xenopus (Silurana) tropicalis* (GenBank accession no. XP_012823768), *Alligator mississippiensis* (GenBank accession no. XP_006263329), *Alligator sinensis* (GenBank accession no. XP_006038704), *Spodoptera frugiperda* (UniProt: H2BEB9, or AEX00082).

Additional examples of characterized active enzymes can be found at cazy.org/GT13_characterized. The 3D structure of the catalytic domain of rabbit GnTI was defined by X-ray crystallography in Unligil U M et al. EMBO J. 2000 Oct. 16; 19(20):5269-80. The Protein Data Bank (PDB) structures for GnTI are 1FO8, 1FO9, 1FOA, 2AM3, 2AM4, 2AM5, and 2APC. In certain embodiments, the N-acetylglucosaminyltransferase I catalytic domain is from the *Phaedactylum tricornutum* N-acetylglucosaminyltransferase I enzyme (SEQ ID NO: 139), *Phaedactylum tricornutum* N-acetylglucosaminyltransferase I enzyme (Gen Bank accession no. XP_002182611) or variants thereof. In certain embodiments, the N-acetylglucosaminyltransferase I catalytic domain contains a sequence that is at least 70%, at least 75%, at least 80%, at least 85%, at least 90%, at least 95%, at least 96%, at least 97%, at least 98%, at least 99%, or 100% identical to amino acid residues 54-444 of SEQ ID NO: 139 (SEQ ID NO:140). In other embodiments, the N-acetylglucosaminyltransferase I catalytic domain is from the human N-acetylglucosaminyltransferase I enzyme (SEQ ID NO: 141) or variants thereof. In certain embodiments, the N-acetylglucosaminyltransferase I catalytic domain contains a sequence that is at least 70%, at least 75%, at least 80%, at least 85%, at least 90%, at least 95%, at least 96%, at least 97%, at least 98%, at least 99%, or 100% identical to amino acid residues 84-445 of SEQ ID NO: 141.

In an embodiment, N-acetylglucosaminyltransferase I catalytic domain is N-acetylglucosaminyltransferase I catalytic domain of a microalgae. In an embodiment, N-acetylglucosaminyltransferase I catalytic domain of the microalgae is selected from the group consisting of *Phaeodactylum, Micromonas, Coccomyxa, Chlorella, Galdieria, Thalassiosira, Fragilariopsis, Emiliania,* and *Guillardia* N-acetylglucosaminyltransferase I catalytic domain.

In an embodiment, N-acetylglucosaminyltransferase I catalytic domain is N-acetylglucosaminyltransferase I catalytic domain of a microalgae. In an embodiment, N-acetylglucosaminyltransferase I catalytic domain of the microalgae is selected from the group consisting of *Phaeodactylum tricornutum* GnTI SEQ ID NO: 139, *Phaeodactylum tricornutum* GnTI (GenBank accession no. XP_002182611, SEQ ID NO:763), *Micromonas* spRCC299 GnTI (GenBank accession no. XP_002507699.1, SEQ ID NO:764), *Micromonas* spRCC299 GnTI (GenBank accession no. XP_002506141.1, SEQ ID NO:765), *Micromonas pusilla* GnTI (GenBank accession no. XP_003056751.1, SEQ ID NO:766), *Coccomyxa subellipsoidea* C-169 GnTI (GenBank accession no. XP_005642764.1, SEQ ID NO:767), *Chlorella variabilis* NC64A GnTI (GenBank accession no. XP_005843911.1, SEQ ID NO:768), *Galdieria sulphuraria* GnTI (GenBank accession no. XP_005709370.1, SEQ ID NO:769), *Galdieria sulphuraria* GnTI (GenBank accession no. XP_005709369.1, SEQ ID NO:770), *Thalassiosira pseudonana* GnTI (GenBank accession no. XP_002286885.1, SEQ ID NO:771), *Thalassiosira oceanica* GnTI (GenBank accession no. EJK75949.1, SEQ ID NO:772), *Fragilariopsis cylindrus* (JGI Protein ID: 189180, SEQ ID NO:773), *Emiliania huxley* GnTI (GenBank accession no. XP_005769752.1, SEQ ID NO:774), and *Guillardia theta* GnTI (GenBank accession no. XP_005818934.1, SEQ ID NO:775).

In some embodiments, a shorter sequence can be used as a catalytic domain (e.g. amino acid residues 105-445 of the human enzyme or amino acid residues 107-447 of the rabbit enzyme; Sarkar et al. (1998) Glycoconjugate J 15:193-197). Constructs of GnTI shorter sequence of the enzymes are described in Table 1 in Example 10.

Additional sequences that can be used as the GnTI catalytic domain include amino acid residues from about amino acid 30 to 445 of the human enzyme or any C-terminal stem domain starting between amino acid residue 30 to 105 and continuing to about amino acid 445 of the human enzyme, or corresponding homologous sequence of another GnTI or a catalytically active variant or mutant thereof. The catalytic domain may include N-terminal parts of the enzyme such as all or part of the stem domain, the transmembrane domain, or the cytoplasmic domain.

The GnTI enzymes or their shorter sequences can be fused to Golgi targeting signal such as KRE2 targeting signals as described for example in Table 1 (see also genomic sequence of *T. reesei* KRE2 of SEQ ID NO:478 and corresponding translated sequence of SEQ ID NO:479 which can be used as a fusion construct with GnT1.

As disclosed herein, N-acetylglucosaminyltransferase II (GlcNAc-TII; GnTII; EC 2.4.1.143) catalyzes the reaction UDP-N-acetyl-D-glucosamine+6-(alpha-D-mannosyl)-beta-D-mannosyl-R<=>UDP+6-(2-(N-acetyl-beta-D-glucosaminyl)-alpha-D-mannosyl)-beta-D-mannosyl-R, where R represents the remainder of the N-linked oligosaccharide in the glycan acceptor. An N-acetylglucosaminyltransferase II catalytic domain is any portion of an N-acetylglucosaminyltransferase II enzyme that is capable of catalyzing this reaction. Amino acid sequences for N-acetylglucosaminyltransferase II enzymes from various organisms are listed in WO2012069593. In certain embodiments, the N-acetylglucosaminyltransferase II catalytic domain is from the human N-acetylglucosaminyltransferase II enzyme (SEQ ID NO: 142) or variants thereof. Additional GnTII species are listed in the CAZy database in the glycosyltransferase family 16 (cazy.org/GT16_all). Enzymatically characterized species include GnTII of *C. elegans, D. melanogaster, Homo sapiens* (NP_002399.1), *Rattus norvegicus, Sus scrofa* (cazy.org/GT16_characterized). In certain embodiments, the N-acetylglucosaminyltransferase II catalytic domain contains a sequence that is at least 70%, at least 75%, at least 80%, at least 85%, at least 90%, at least 95%, at least 96%, at least 97%, at least 98%, at least 99%, or 100% identical to amino acid residues from about 30 to about 447 of SEQ ID NO: 142. The catalytic domain may include N-terminal parts of the enzyme such as all or part of the stem domain, the transmembrane domain, or the cytoplasmic domain.

In embodiments where the filamentous fungal cell contains a fusion protein of the invention, the fusion protein may further contain a spacer in between the N-acetylglucosaminyltransferase I catalytic domain and the N-acetylglucosaminyltransferase II catalytic domain. In certain embodiments, the spacer is an EGlV spacer, a 2xG4S spacer, a 3xG4S spacer, or a CBHI spacer. In other embodiments, the spacer contains a sequence from a stem domain.

For ER/Golgi expression the N-acetylglucosaminyltransferase I and/or N-acetylglucosaminyltransferase II catalytic domain is typically fused with a targeting peptide or a part of an ER or early Golgi protein, or expressed with an endogenous ER targeting structures of an animal or plant N-acetylglucosaminyltransferase enzyme. In certain preferred embodiments, the N-acetylglucosaminyltransferase I and/or N-acetylglucosaminyltransferase II catalytic domain contains any of the targeting peptides of the invention as described in the section entitled "Targeting sequences". Preferably, the targeting peptide is linked to the N-terminal end of the catalytic domain. In some embodiments, the targeting peptide contains any of the stem domains of the invention as described in the section entitled "Targeting sequences". In certain preferred embodiments, the targeting peptide is a Kre2/Mnt1 targeting peptide. In other embodiments, the targeting peptide further contains a transmembrane domain linked to the N-terminal end of the stem domain or a cytoplasmic domain linked to the N-terminal end of the stem domain. In embodiments where the targeting peptide further contains a transmembrane domain, the targeting peptide may further contain a cytoplasmic domain linked to the N-terminal end of the transmembrane domain.

The filamentous fungal cells may also contain a polynucleotide encoding a UDP-GlcNAc transporter. The polynucleotide encoding the UDP-GlcNAc transporter may be endogenous (i.e., naturally present) in the host cell, or it may be heterologous to the filamentous fungal cell.

Microalgae Glycosylation Enzymes in Filamentous Fungi

In an embodiment, a filamentous fungus of the invention, for example, *Trichoderma reesei*, comprises
  i) a recombinant nucleotide encoding a microalgae α1,2 mannosidase,
  ii) a recombinant nucleotide encoding a microalgae N-acetylglucosaminyltransferase I catalytic domain; and
  iii) either,
    a. a recombinant nucleotide encoding a catalytic domain of a subunit of microalgae α-glucosidase II,
    b. a recombinant nucleotide encoding a catalytic domain of a subunit and a recombinant nucleotide encoding β subunit of microalgae α-glucosidase II, or
    c. a recombinant nucleotide encoding a β subunit of microalgae α-glucosidase II; and optionally
  iv) a recombinant nucleotide encoding a catalytic domain of microalgae α-glucosidase I.

In an embodiment, the microalgae is *Phaeodactylum tricornutum*.

In an embodiment, α1,2 mannosidase is selected from the group consisting of: *Phaeodactylum tricornutum* α1,2 mannosidase, *Chlamydomonas reinharditii* α1,2-mannosidase, *Volvox carteri f. nagariensis* α1,2-mannosidase, *Ostreococcus lucimarinus* α1,2-mannosidase, *Ostreococcus tauri* α1,2-mannosidase, *Micromonas pusilla* α1,2-mannosidase, *Coccomyxa subellipsoidea* α1,2-mannosidase, *Chlorella variabilis* α1,2-mannosidase, *Cyanidioschyzon merolae* α1,2-mannosidase, *Thalassiosira pseudonana* α1,2-mannosidase, *Fragilariopsis cylindrus* α1,2-mannosidase, *Aureococcus anophagereffens* α1,2-mannosidase, *Emiliania huxley* α1,2-mannosidase, and *Guillardia theta* α1,2-mannosidase.

In an embodiment, GnTI is selected from the group consisting of: *Phaeodactylum tricornutum* GnTI, *Micromonas pusilla* GnTI, *Coccomyxa subellipsoidea* GnTI, *Chlorella variabilis* GnTI, *Galdieria sulphuraria* GnTI, *Thalassiosira pseudonana* GnTI, *Thalassiosira oceanica* GnTI, *Fragilariopsis cylindrus* GnTI, *Emiliania huxley* GnTI, and *Guillardia theta* GnTI.

In an embodiment, a subunit of microalgae α-glucosidase II is selected from the group consisting of: *Phaeodactylum tricornutum* α-glucosidase II α subunit, *Chlamydomonas reinhardtii* α-glucosidase II α subunit, *Volvox carteri f. nagariensis* α-glucosidase II α subunit, *Ostreococcus tauri* α-glucosidase II α subunit, *Micromonas pusilla* α-glucosidase II α subunit, *Coccomyxa subellipsoidea* α-glucosidase II α subunit, *Chlorella variabilis* α-glucosidase II α subunit, *Cyanidioschyzon merolae* α-glucosidase II α subunit, *Galdieria sulphuraria* α-glucosidase II α subunit, *Thalassiosira pseudonana* α-glucosidase II α subunit, *Fragilariopsis cylindrus* α-glucosidase II α subunit, *Aureococcus anophagefferens* α-glucosidase II α subunit, *Nannochloropsis gaditana* α-glucosidase II α subunit, *Emiliania huxleyi* α-glucosidase II α subunit, and *Guillardia theta* α-glucosidase II α subunit.

In an embodiment, β subunit of microalgae α-glucosidase II is selected from the group consisting of: *P. tricornutum* α-glucosidase II β subunit, *Chlamydomonas reinhardtii* α-glucosidase II β subunit, *Volvox carteri f. nagariensis* α-glucosidase II β subunit, *Ostreococcus tauri* α-glucosidase II β subunit, *Micromonas pusilla* α-glucosidase II β subunit, *Coccomyxa subellipsoidea* α-glucosidase II β subunit, *Chlorella variabilis* α-glucosidase II β subunit, *Cyanidioschyzon merolae* α-glucosidase II β subunit, *Galdieria sulphuraria* α-glucosidase II β subunit, *Thalassiosira pseudonana* α-glucosidase II β subunit, *Thalassiosira oceanica* α-glucosidase II β subunit, *Fragilariopsis cylindrus* α-glucosidase II β subunit, *Aureococcus anophagereffens* α-glucosidase II β subunit, *Nannochloropsis gaditana* α-glucosidase II β subunit, *Emiliania huxleyi* α-glucosidase II β subunit, and *Guillardia theta* α-glucosidase II β subunit.

In an embodiment, microalgae α-glucosidase I is selected from the group consisting of: *Chlamydomonas reinhardtii* α-glucosidase I, *Volvox carteri f. nagariensis* α-glucosidase I, *Coccomyxa subellipsoidea* α-glucosidase I, *Chlorella variabilis* -60 -glucosidase I, *Cyanidioschyzon merolae* α-glucosidase I, *Galdieria sulphuraria* α-glucosidase I, *Nannochloropsis gaditana* α-glucosidase I, and *Emiliania huxley* α-glucosidase I.

In an embodiment, α1,2 mannosidase is *Phaeodactylum tricornutum* α1,2 mannosidase (GenBank accession no. XP_002176357) or *Chlamydomonas reinharditii* α1,2-mannosidase (GenBank accession no. XP_001700094), GnTI is *Phaeodactylum tricornutum* GnTI (SEQ ID NO: 139 or GenBank accession no. XP_002182611), a subunit is a subunit of *Phaeodactylum tricornutum* α-glucosidase II (GenBank accession no. XP_002178760.1) or *Chlamydomonas reinhardtii* α-glucosidase II α subunit (GenBank accession no. XP_001692042.1), and β subunit is β subunit of *Phaeodactylum tricornutum* α-glucosidase II (GenBank accession no. XP_002186069) or *Chlamydomonas reinhardtii* α-glucosidase II β subunit (SEQ ID NO: 792), and optionally, α-glucosidase I is *Chlamydomonas reinharditii* α-glucosidase I (JGI locus name Cre13.g579734).

Galactosyltransferase

In certain embodiments, the filamentous fungal cell may also further contain a polynucleotide encoding a galactosyltransferase. Galactosyltransferases transfer β-linked galactosyl residues to terminal N-acetylglucosaminyl residue. In certain embodiments the galactosyltransferase is a β-1,4-galactosyltransferase. Generally, β□1,4-galactosyltransferases belong to the CAZy glycosyltransferase family 7 (cazy.org/GT7_all.html) and include β-N-acetylglucosaminyl-glycopeptide β-1,4-galactosyltransferase (EC 2.4.1.38), which is also known as N-acetyllactosamine synthase (EC 2.4.1.90). Useful subfamilies include β4-GalT1, β4-GalT-II, -III, -IV, -V, and -VI, such as mammalian or human β4-GalTI or β4GalT-II, -III, -IV, -V, and -VI or any combinations thereof. β4-GalT1, β4-GalTII, or β4-GalTIII are especially useful for galactosylation of terminal GlcNAcβ2-structures on N-glycans such as GlcNAcMan3, GlcNAc2Man3, or GlcNAcMan5 (Guo S. et al. Glycobiology 2001, 11:813-20). The three-dimensional structure of the catalytic region is known (e.g. (2006) J. Mol. Biol. 357: 1619-1633), and the structure has been represented in the PDB database with code 2FYD. The CAZy database includes examples of certain enzymes. Characterized enzymes are also listed in the CAZy database at cazy.org/GT7_characterized.html. Examples of useful β4GalT enzymes include β4GalT1, e.g. bovine Bos taurus enzyme AAA30534.1 (Shaper N. L. et al Proc. Natl. Acad. Sci. U.S.A. 83 (6), 1573-1577 (1986)), human enzyme (Guo S. et al. Glycobiology 2001, 11:813-20), and *Mus musculus* enzyme AAA37297 (Shaper, N. L. et al. 1998 J. Biol. Chem. 263 (21), 10420-10428); β4GalTII enzymes such as human β4GalTII BAA75819.1, Chinese hamster *Cricetulus griseus* AAM77195, *Mus musculus* enzyme BAA34385, and Japanese Medaka fish *Oryzias latipes* BAH36754; and β4GalTIII enzymes such as human β4GalTIII BAA75820.1, Chinese hamster *Cricetulus griseus* AAM77196 and *Mus musculus* enzyme AAF22221.

The galactosyltransferase may be expressed in the plasma membrane of the host cell. A heterologous targeting peptide, such as a Kre2 peptide described in Schwientek J. Biol. Chem 1996 3398, may be used. Promoters that may be used for expression of the galactosyltransferase include constitutive promoters such as gpd, promoters of endogenous glycosylation enzymes and glycosyltransferases such as mannosyltransferases that synthesize N-glycans in the Golgi or ER, and inducible promoters of high-yield endogenous proteins such as the cbh1 promoter.

In certain embodiments of the invention where the filamentous fungal cell contains a polynucleotide encoding a galactosyltransferase, the filamentous fungal cell also contains a polynucleotide encoding a UDP-Gal 4 epimerase and/or UDP-Gal transporter. In certain embodiments of the invention where the filamentous fungal cell contains a polynucleotide encoding a galactosyltransferase, lactose may be used as the carbon source instead of glucose when culturing the host cell. The culture medium may be between pH 4.5 and 7.0 or between 5.0 and 6.5. In certain embodiments of the invention where the filamentous fungal cell contains a polynucleotide encoding a galactosyltransferase and a polynucleotide encoding a UDP-Gal 4 epimerase and/or UDP-Gal transporter, a divalent cation such as $Mn^{2+}$, $Ca^{2+}$ or $Mg^{2+}$ may be added to the cell culture medium.

Fucosylation Pathway

Genes and proteins involved in the fucosylation pathways of prokaryotes and eukaryotes have been identified and characterized in the art (see for a review, Ma et al, 2006, Glycobiology, 16(12) 158-144).

As used herein the term "fucosylation pathway" relates to the sequential enzymatic steps required for in vivo fucosylation of a glycoprotein. There is no fucosylation pathway in filamentous fungal cells, such as *Trichoderma* cells. In vivo fucosylation requires at least expression of one enzyme of the fucosyltransferase family. Accordingly, a filamentous fungal cell according to the invention may optionally comprise at least one polynucleotide encoding fucosyltransferase activity, for the production of heterologous glycoproteins with fucosylated glycoforms.

If GDP-fucose is not provided in the medium or naturally synthesized in the filamentous fungal cell, the filamentous fungal cell according to the invention may advantageously contain one or more polynucleotides encoding GDP-fucose synthesis and, optionally, GDP-fucose transporter.

Depending on the structure of the fucosylated N-glycan that is desired to be produced by the filamentous fungal cell according to the invention, the skilled person will select the appropriate sequences encoding polypeptides with fucosyltransferase activity.

Various fucosyltransferase enzymes and their coding sequences have been identified in the art. Fucosyltransferase (FucTs) are indeed widely expressed in vertebrates such as mammalian and human cells, invertebrates, plants and bacteria. FucT belong to the glycosyltransferase superfamily (EC 2.4.1.x.y) which is defined in the category of Carbohydrate-Active enzymes (CAZY) available on the internet.

More specifically, as use herein, the term "fucosyltransferase" or "FucTs" refers to the enzyme catalysing the reaction that transfers the donor guanosine-diphosphate fucose (GDP-Fuc) to an acceptor glycoprotein.

FucTs thus include enzymes with α1,2 fucosyltransferase activity (encoded for example by human FUT1 and FUT2 genes), α1,3/α1,4 fucosyltransferase activity (encoded for example by human FUT9 and FUTS genes), O-FucTs (encoded for example by plant O-FUT1 and 2) and α1,6 fucosyltransferase activity (encoded for example by human FUT8 gene), which is further described in detail below.

In a preferred embodiment, the filamentous fungal cell according to the invention may comprise a polynucleotide encoding a polypeptide having α1,6 fucosyltransferase activity. α1,6 FucT adds fucose to the innermost GlcNAc moiety of the chitobiose unit of the core Asn-linked glycans at an α1,6 linkage. In mammals, α1,6 fucosyltransferase acting at late Golgi cisternae requires an unsubstituted β1,2 linked GlcNAc on the α1,3 mannose arm of the core N-glycan. α1,6 fucosyltransferase activity is useful in particular in methods for producing fucosylated complex N-glycans such as the FG0, FG1 or FG2 glycoforms.

Human α1,6 FucT encoded by FUT8 gene is widely expressed in human tissues. Polynucleotide sequences encoding α1,6 FucT that may be used in the present invention includes without limitation the human FUT8 coding sequence of SEQ ID NO:143, FUT8 isoforms or other homologous FUT8 coding sequences from mammalian species, including without limitation any one of SEQ ID NOs 144-151.

In one embodiment, said filamentous fungal cell of the invention comprises a polynucleotide of human FUT8 coding sequence (SEQ ID NO:143), or a functional variant polynucleotide encoding a polypeptide having at least 50%, at least 60%, at least 70%, at least 90%, or at least 95% identity with SEQ ID NO:152, said functional variant encoding α1,6 fucosyltransferase activity.

Expression of α1,6 fucosyltransferase activity in a filamentous fungal cell of the invention may be determined by structural analysis of N-glycans produced by such filamentous fungal cell, as described in the Examples below.

The substrate of fucosyltransferase is GDP-fucose. In order to obtain in vivo fucosylation, it is therefore advantageous to provide filamentous fungal cells which further comprise enzymes required for GDP-fucose synthesis and its transport into the ER/Golgi compartment where fucosyltransferase reaction occurs. Accordingly, the filamentous fungal cell may advantageously further comprise one or more polynucleotides encoding GDP-fucose synthesis and, optionally, GDP-fucose transporter.

In eukaryote, GDP-fucose synthesis can be synthesized either by the de novo pathway or the minor salvage pathway. The de novo pathway starts from GDP-D-mannose which is dehydrated by GDP-mannose-4,6 dehydratase (hereafter referred as "GMD"). This leads to the formation of an unstable GDP-4-keto-6-deoxy-D-mannose, which undergoes a subsequent 3,5 epimerization and then a NADPH-dependent reduction with the consequent formation of GDP-L-fucose. These two last steps are catalysed by GDP-4-keto-6-deoxy-D-mannose-3,5-epimerase/4-reductase (hereafter referred as "FX").

Accordingly, in a specific embodiment, the filamentous fungal cell of the invention, for example *Trichoderma* cell further comprises one or more polynucleotides encoding a polypeptide having GDP-fucose synthesis activity, selected from the group consisting of:

(i) GMD polynucleotide or a functional variant polynucleotide encoding a polypeptide having GDP-mannose-dehydratase activity; and, (ii) FX polynucleotide or a functional variant polynucleotide encoding a polypeptide having both GDP-keto-deoxy-mannose-epimerase and GDP-keto-deoxy-galactose-reductase activities.

GMD encoding polynucleotide sequences have been described in the art and include without limitation *C. elegans* GMD optimized polynucleotide of SEQ ID NO:153, *H. pylori* GMD optimized polynucleotide of SEQ ID NO:154, or polynucleotides encoding homologous eukaryotic proteins of any one of SEQ ID NOs:155-169 or polynucleotides encoding homologous prokaryotic proteins of any one of SEQ ID NOs: 170-172, or their functional variant polynucleotide encoding polypeptides having at least 50%, at least 60%, at least 70%, at least 90%, or at least 95% identity with said any one of SEQ ID NO:173, SEQ ID NO:174 or SEQ ID NOs: 155-172, and having GDP-mannose-dehydratase activity (see also Mattila et al., 2000, Glycobiology 10(10) pp 1041-1047 and Jarvinen et al, 2001, Eur J Biochem 268, 6458-6464).

FX encoding polynucleotide sequences have also been described in the art and include without limitation *C. elegans* FX polynucleotide of SEQ ID NO: 175, H. pylori FX polynucleotide of SEQ ID NO: 176 or a homologous FX polynucleotide encoding any one of SEQ ID NOs 177-188, or their functional variant polynucleotide encoding a polypeptide having at least 50%, at least 60%, at least 70%, at least 90%, or at least 95% identity with any one of said polynucleotide sequences of SEQ ID NO:189, SEQ ID NO:190 or SEQ ID NOs: 177-188 and having both GDP-keto-deoxy-mannose-epimerase and GDP-keto-deoxy-galactose-reductase activities (see also Mattila et al., 2000, Glycobiology 10(10) pp 1041-1047 and Jarvinen et al, 2001, Eur J Biochem 268, 6458-6464).

In one specific embodiment, the filamentous fungal cell of the invention, such as a *Trichoderma* cell, further comprises said one or more polynucleotides encoding polypeptides with GDP-fucose synthesis activity comprising (i) *C. elegans* GMD polynucleotide of SEQ ID NO:153 or a functional variant polynucleotide encoding a polypeptide having at least 50%, at least 60%, at least 70%, at least 90%, or at least 95% identity with SEQ ID NO:173 and having GDP-mannose-dehydratase activity; and, (ii) *C. elegans* FX polynucleotide of SEQ ID NO:175 or a functional variant polynucleotide encoding a polypeptide having at least 50%, at least 60%, at least 70%, at least 90%, or at least 95% identity with SEQ ID NO:189 and having both GDP-keto-deoxy-mannose-epimerase and GDP-keto-deoxy-galactose-reductase activities.

GDP-fucose synthesis may be detected in vivo for example by purification and MALDI-TOF MS analysis of GDP-L-fucose as described in Mattila et al 2000, supra.

GDP-fucose synthesis takes place in the cytosol whereas fucosyltransferase activity occurs in vivo in the Golgi compartment. Therefore, it may be advantageous to further introduce into the filamentous fungal cell of the invention a polynucleotide encoding GDP fucose transporter (hereafter referred as "GFTr").

GDP fucose transporter encoding genes have been cloned and characterized from various organisms. GDP fucose transporter encoding polynucleotide includes without limitation *C. elegans* GDP fucose transporter polynucleotide of SEQ ID NO: 191, a homologous FX polynucleotide encoding any one of SEQ ID NOs: 192-204, or their functional variant polynucleotide encoding a polypeptide at least 50%, at least 60%, at least 70%, at least 90%, or at least 95% identity with any one of SEQ ID NO:205, or SEQ ID NOs: 192-204 and having GDP fucose transporter.

In one specific embodiment, the filamentous fungal cell of the invention, such as a *Trichoderma* cell, further comprises a GDP-fucose transporter *C. elegans* GFTr polynucleotide of SEQ ID NO:191 or a functional variant polynucleotide encoding a polypeptide having at least 50%, at least 60%, at least 70%, at least 90%, or at least 95% identity with SEQ ID NO:205 and having GDP fucose transporter.

To increase Golgi targeting of fucosyltransferase, it may be required to include Golgi targeting sequence in the polynucleotide encoding fucosyltransferase activity that is introduced in the filamentous fungal cell according to the invention.

Accordingly, the filamentous fungal cell of the invention may comprise a polynucleotide encoding fucosyltransferase linked to a Golgi targeting sequence for targeting expression of said fucosyltransferase activity in the Golgi compartment.

Other targeting sequences that may be used are described more in details in the next section.

In a specific embodiment, a filamentous fungal cell according to the invention, such as *Trichoderma* cell, further comprises a polynucleotide encoding the N-terminal portion of Golgi targeting sequence of SEQ ID NO:206, or a functional variant polynucleotide having at least 50%, at least 60%, at least 70%, at least 90%, or at least 95% identity with SEQ ID NO:207 linked to the polynucleotide sequence encoding fucosyltransferase activity, such as SEQ ID NO:143. In such embodiment, a preferred filamentous fungal cell is a *Trichoderma reesei* cell.

In a specific embodiment, the filamentous fungal cell of the invention, preferably a *Trichoderma* cell, and more preferably a *Trichoderma reesei* cell, may further comprise the following features:

(i) a polynucleotide encoding GMD and FX activities for GDP-fucose synthesis, (ii) a polynucleotide encoding GDP-fucose transporter, for transporting GDP-fucose transporter in the Golgi compartment where fucosyltansferase activity occurs in vivo, and/or, (iii) a polynuceotide encoding α1,6 fucosyltransferase activity linked with a Golgi targeting sequence for targeting said α1,6 fucosylytransferase activity to the Golgi compartment.

Targeting Sequences

In certain embodiments, recombinant enzymes, such as α1,2 mannosidases, GnTI, or other glycosyltransferases introduced into the filamentous fungal cells, include a targeting peptide linked to the catalytic domains. The term "linked" as used herein means that two polymers of amino acid residues in the case of a polypeptide or two polymers of nucleotides in the case of a polynucleotide are either coupled directly adjacent to each other or are within the same polypeptide or polynucleotide but are separated by intervening amino acid residues or nucleotides. A "targeting peptide", as used herein, refers to any number of consecutive amino acid residues of the recombinant protein that are capable of localizing the recombinant protein to the endoplasmic reticulum (ER) or Golgi apparatus (Golgi) within the host cell. The targeting peptide may be N-terminal or C-terminal to the catalytic domains. In certain embodiments, the targeting peptide is N-terminal to the catalytic domains. In certain embodiments, the targeting peptide provides binding to an ER or Golgi component, such as to a mannosidase II enzyme. In other embodiments, the targeting peptide provides direct binding to the ER or Golgi membrane.

Components of the targeting peptide may come from any enzyme that normally resides in the ER or Golgi apparatus. Such enzymes include mannosidases, mannosyltransferases, glycosyltransferases, Type 2 Golgi proteins, and MNN2, MNN4, MNN6, MNN9, MNN10, MNS1, KRE2, VAN1, and OCH1 enzymes. Such enzymes may come from a yeast or fungal species such as those of *Acremonium, Aspergillus, Aureobasidium, Cryptococcus, Chrysosporium, Chrysosporium lucknowense, Filobasidium, Fusarium, Gibberella, Humicola, Magnaporthe, Mucor, Myceliophthora, Myrothecium, Neocallimastix, Neurospora, Paecilomyces, Penicillium, Piromyces, Schizophyllum, Talaromyces, Thermoascus, Thielavia, Tolypocladium,* and *Trichoderma.* Sequences for such enzymes can be found in the GenBank sequence database.

In certain embodiments the targeting peptide comes from the same enzyme and organism as one of the catalytic domains of the recombinant protein. For example, if the recombinant protein includes a human GnTII catalytic domain, the targeting peptide of the recombinant protein is from the human GnTII enzyme. In other embodiments, the targeting peptide may come from a different enzyme and/or organism as the catalytic domains of the recombinant protein.

Examples of various targeting peptides for use in targeting proteins to the ER or Golgi that may be used for targeting the recombinant enzymes, include: Kre2/Mnt1 N-terminal peptide fused to galactosyltransferase (Schwientek, J B C 1996, 3398), HDEL for localization of mannosidase to ER of yeast cells to produce Man5 (Chiba, J B C 1998, 26298-304; Callewaert, FEBS Lett 2001, 173-178), OCH1 targeting peptide fused to GnTI catalytic domain (Yoshida et al, Glycobiology 1999, 53-8), yeast N-terminal peptide of Mns1 fused to α2-mannosidase (Martinet et al, Biotech Lett 1998, 1171), N-terminal portion of Kre2 linked to catalytic domain of GnTI or β4GalT (Vervecken, Appl. Environ Microb 2004, 2639-46), various approaches reviewed in Wildt and Gerngross (Nature Rev Biotech 2005, 119), full-length GnTI in *Aspergillus nidulans* (Kalsner et al, Glycocon. J 1995, 360-370), full-length GnTI in *Aspergillus oryzae* (Kasajima et al, Biosci Biotech Biochem 2006, 2662-8), portion of yeast Sec12 localization structure fused to *C. elegans* GnTI in *Aspergillus* (Kainz et al 2008), N-terminal portion of yeast Mnn9 fused to human GnTI in *Aspergillus* (Kainz et al 2008), N-terminal portion of *Aspergillus* Mnn10 fused to human GnTI (Kainz et al, Appl. Environ Microb 2008, 1076-86), and full-length human GnTI in *T. reesei* (Maras et al, FEBS Lett 1999, 365-70).

In certain embodiments the targeting peptide is an N-terminal portion of the Mnt1/Kre2 targeting peptide having the amino acid sequence of SEQ ID NO: 208 (for example encoded by the polynucleotide of SEQ ID NO:209). In certain embodiments, the targeting peptide is selected from human GNT2, KRE2, KRE2-like, Och1, Anp1, Van1 as shown in the Table 2 below:

TABLE 2

Targeting peptides. Putative transmembrane domains are underlined. In KRE2/MNT1, the stem domain enabling Golgi localization is underlined and double-underlined. Other01 and Other02 are putative mannosylation-related proteins.

| Homologous to | Cytoplasmic | Transmembrane | Luminal |
|---|---|---|---|
| KRE2 | SEQ ID NO: 210 | SEQ ID NO: 211 | SEQ ID NO: 212 |
| KRE2 alternative 1 | SEQ ID NO: 213 | SEQ ID NO: 214 | SEQ ID NO: 215 |
| OCH1 | SEQ ID NO: 216 | SEQ ID NO: 217 | SEQ ID NO: 218 |
| OCH1 alternative 1 | SEQ ID NO: 219 | SEQ ID NO: 220 | SEQ ID NO: 221 |
| MNN9 | SEQ ID NO: 222 | SEQ ID NO: 223 | SEQ ID NO: 224 |
| MNN9 alternative 1 | SEQ ID NO: 225 | SEQ ID NO: 226 | SEQ ID NO: 227 |
| MNN9 alternative 2 | SEQ ID NO: 228 | SEQ ID NO: 229 | SEQ ID NO: 230 |
| MNN10 | SEQ ID NO: 231 | SEQ ID NO: 232 | SEQ ID NO: 233 |
| MNN10 alternative 1 | SEQ ID NO: 234 | SEQ ID NO: 235 | SEQ ID NO: 236 |
| MNS1 | SEQ ID NO: 237 | SEQ ID NO: 238 | SEQ ID NO: 239 |
| MNS1 alternative 1 | SEQ ID NO: 240 | SEQ ID NO: 241 | SEQ ID NO: 242 |
| MNS1 alternative 2 | SEQ ID NO: 243 | SEQ ID NO: 244 | SEQ ID NO: 245 |
| MNS1 alternative 3 | SEQ ID NO: 246 | SEQ ID NO: 247 | SEQ ID NO: 248 |
| MNS1 alternative 4 | — | SEQ ID NO: 249 | SEQ ID NO: 250 |
| VAN1 | SEQ ID NO: 251 | SEQ ID NO: 252 | SEQ ID NO: 253 |
| VAN1 alternative 1 | SEQ ID NO: 254 | SEQ ID NO: 255 | SEQ ID NO: 256 |
| VAN1 alternative 2 | SEQ ID NO: 257 | SEQ ID NO: 258 | SEQ ID NO: 259 |
| Other01 | SEQ ID NO: 260 | SEQ ID NO: 261 | SEQ ID NO: 262 |
| Other02 | SEQ ID NO: 263 | SEQ ID NO: 264 | SEQ ID NO: 265 |

Further examples of sequences that may be used for targeting peptides include the targeting sequences as described in WO2012/069593.

Uncharacterized sequences may be tested for use as targeting peptides by expressing enzymes of the glycosylation pathway in a host cell, where one of the enzymes contains the uncharacterized sequence as the sole targeting peptide, and measuring the glycans produced in view of the cytoplasmic localization of glycan biosynthesis (e.g. as in Schwientek J B C 1996 3398), or by expressing a fluorescent reporter protein fused with the targeting peptide, and analysing the localization of the protein in the Golgi by immunofluorescence or by fractionating the cytoplasmic membranes of the Golgi and measuring the location of the protein.

Methods for Producing a Glycoprotein with Predominant Mammalian-like Glycoforms

The filamentous fungal cells as described above are useful in methods for producing a heterologous glycoprotein, wherein at least 90% (mol %) preferably at least 95%, of the total neutral N-glycans of said produced heterologous glycoprotein are from the group consisting of:

Manα3[Manα6(Manα3)Manα6]
    Manβ4GlcNAβ4GlcNAc (Man5 glycoform);
GlcNAcβ2Manα3[Manα6(Manα3)Manα6]
    Manβ4GlcNAβ4GlcNAc (GlcNAcMan5 glycoform);
Manα6(Manα3)Manβ4GlcNAβ4GlcNAc (Man3 glycoform);
Manα6(GlcNAcβ2Manα3)Manβ4GlcNAβ4GlcNAc (GlcNAcMan3 glycoform);
complex type N-glycans selected from the G0, G1, or G2 glycoform; and,
complex type fucosylated N-glycans FG0, FG1, or FG2 glycoform.

Accordingly, in another aspect, the invention relates to a method for producing a heterologous glycoprotein, such as an antibody, with predominant mammalian-like glycoforms, comprising
a) providing a filamentous fungal cell according to the invention, as described above, for example a *Trichoderma* cell;
b) culturing the cell under appropriate conditions for the production of the heterologous glycoprotein; and optionally, its secretion in the culture medium; and,
c) recovering said heterologous glycoprotein and, optionally, purifying the heterologous glycoprotein.

In methods of the invention, certain growth media include, for example, common commercially-prepared media such as Luria-Bertani (LB) broth, Sabouraud Dextrose (SD) broth or Yeast medium (YM) broth. Other defined or synthetic growth media may also be used and the appropriate medium for growth of the particular host cell will be known by someone skilled in the art of microbiology or fermentation science. Culture medium typically has the *Trichoderma reesei* minimal medium (Penttilä et al., 1987, Gene 61, 155-164) as a basis, supplemented with substances inducing the production promoter such as lactose, cellulose, spent grain or sophorose. Temperature ranges and other conditions suitable for growth are known in the art (see, e.g., Bailey and Ollis 1986). In certain embodiments the pH of cell culture is between 3.5 and 7.5, between 4.0 and 7.0, between 4.5 and 6.5, between 5 and 5.5, or at 5.5. In certain embodiments, to produce an antibody the filamentous fungal cell or *Trichoderma* fungal cell is cultured at a pH range selected from 4.7 to 6.5; pH 4.8 to 6.0; pH 4.9 to 5.9; and pH 5.0 to 5.8.

In certain embodiments, cellulose % (g/liter) in the culture medium is between 2-15%. In certain embodiments, sorbitol % (g/liter) in the culture medium is between 2-10%.

In some embodiments of the invention, the method comprises culturing in a medium comprising one or two protease inhibitors.

In a specific embodiment of the invention, the method comprises culturing in a medium comprising one or two protease inhibitors selected from SBTI and chymostatin.

In some embodiments, the heterologous glycoprotein is a mammalian glycoprotein. In other embodiments, the heterologous glycoprotein is a non-mammalian glycoprotein.

In certain embodiments, a mammalian glycoprotein is selected from an immunoglobulin, immunoglobulin or antibody heavy or light chain, or a monoclonal antibody or their N-glycosylated fragments.

A fragment of a protein, as used herein, consists of at least 10, 20, 30, 40, 50, 60, 70, 80, 90, 100 consecutive amino acids of a reference protein.

As used herein, an "immunoglobulin" refers to a multimeric protein containing a heavy chain and a light chain covalently coupled together and capable of specifically combining with antigen. Immunoglobulin molecules are a large family of molecules that include several types of molecules such as IgM, IgD, IgG, IgA, and IgE.

As used herein, an "antibody" refers to intact immunoglobulin molecules, as well as fragments thereof which are capable of binding an antigen. These include hybrid (chimeric) antibody molecules (see, e.g., Winter et al. Nature 349:293-99225, 1991; and U.S. Pat No. 4,816,567 226); F(ab')2 molecules; non-covalent heterodimers; dimeric and trimeric antibody fragment constructs; humanized antibody molecules (see e.g., Riechmann et al. Nature 332, 323-27, 1988; Verhoeyan et al. Science 239, 1534-36, 1988; and GB 2,276,169); and any functional fragments obtained from such molecules, as well as antibodies obtained through non-conventional processes such as phage display or transgenic mice. Preferably, the antibodies are classical antibodies with Fc region. Methods of manufacturing antibodies are well known in the art.

In further embodiments, the yield of the mammalian glycoprotein, for example, the antibody, is at least 0.5, at least 1, at least 2, at least 3, at least 4, or at least 5 grams per liter.

In certain embodiments, the mammalian glycoprotein is an antibody, optionally, IgG1, IgG2, IgG3, or IgG4. In further embodiments, the yield of the antibody is at least 0.5, at least 1, at least 2, at least 3, at least 4, or at least 5 grams per liter. In further embodiments, the mammalian glycoprotein is an antibody, and the antibody contains at least 70%, at least 80%, at least 90%, at least 95%, or at least 98% of a natural antibody C-terminus and N-terminus without additional amino acid residues. In other embodiments, the mammalian glycoprotein is an antibody, and the antibody contains at least 70%, at least 80%, at least 90%, at least 95%, or at least 98% of a natural antibody C-terminus and N-terminus that do not lack any C-terminal or N-terminal amino acid residues.

In certain embodiments where the mammalian glycoprotein (e.g. the antibody) is purified from cell culture, the culture containing the mammalian glycoprotein contains polypeptide fragments that make up a mass percentage that is less than 50%, less than 40%, less than 30%, less than 20%, or less than 10% of the mass of the produced polypeptides. In certain preferred embodiments, the mammalian glycoprotein is an antibody, and the polypeptide fragments are heavy chain fragments and/or light chain fragments. In other embodiments, where the mammalian glycoprotein is an antibody and the antibody purified from cell culture, the culture containing the antibody contains free heavy chains and/or free light chains that make up a mass percentage that is less than 50%, less than 40%, less than 30%, less than 20%, or less than 10% of the mass of the produced antibody. Methods of determining the mass percentage of polypeptide fragments are well known in the art and include, measuring signal intensity from an SDS-gel.

In other embodiments, the heterologous glycoprotein (e.g. the antibody) comprises the trimannosyl N-glycan structure Manα3[Manα6]Manβ4GlcNAcβ4GlcNAc. In some embodiments, the Manα3[Manα6]Manβ4GlcNAcβ4GlcNAc structure represents at least 90% (mol %) or more, of the total N-glycans of the heterologous glycoprotein (e.g. the antibody) composition obtained by the methods of the invention. In other embodiments, the heterologous glycoprotein (e.g. the antibody) comprises the G0 N-glycan structure GlcNAcβ2Manα3[GlcNAcβ2Manα6]Manβ4GlcNAcβ4GlcNAc. In other embodiments, the non-fucosylated G0 glycoform structure represents at least 90% (mol %) or more, of the total N-glycans of the heterologous glycoprotein (e.g. the antibody) composition obtained by the methods of the invention. In other embodiments, galactosylated N-glycans represents less (mol %) than 0.5%, 0.1%, 0.05%, 0.01% of total N-glycans of the culture, and/or of the heterologous glycoprotein with increased N-glycosylation site occupancy. In certain embodiments, the culture or the heterologous glycoprotein, for example an antibody, comprises no galactosylated N-glycans.

In certain embodiments of any of the disclosed methods, the method includes the further step of providing one or more, two or more, three or more, four or more, or five or more protease inhibitors. In certain embodiments, the protease inhibitors are peptides that are co-expressed with the mammalian glycoprotein. In other embodiments, the inhibitors inhibit at least two, at least three, or at least four proteases from a protease family selected from aspartic proteases, trypsin-like serine proteases, subtilisin proteases, and glutamic proteases.

In certain embodiments of any of the disclosed methods, the filamentous fungal cell or *Trichoderma* fungal cell also contains a carrier protein. As used herein, a "carrier protein" is portion of a protein that is endogenous to and highly secreted by a filamentous fungal cell or *Trichoderma* fungal cell. Suitable carrier proteins include, without limitation, those of *T. reesei* mannanase I (Man5A, or MANI), *T. reesei* cellobiohydrolase II (Cel6A, or CBHII) (see, e.g., Paloheimo et al Appl. Environ. Microbiol. 2003 December; 69(12): 7073-7082) or *T. reesei* cellobiohydrolase I (CBHI). In some embodiments, the carrier protein is CBH1. In other embodiments, the carrier protein is a truncated *T. reesei* CBH1 protein that includes the CBH1 core region and part of the CBH1 linker region. In some embodiments, a carrier such as a cellobiohydrolase or its fragment is fused to an antibody light chain and/or an antibody heavy chain. In some embodiments, a carrier-antibody fusion polypeptide comprises a Kex2 cleavage site. In certain embodiments, Kex2, or other carrier cleaving enzyme, is endogenous to a filamentous fungal cell. In certain embodiments, carrier cleaving protease is heterologous to the filamentous fungal cell, for example, another Kex2 protein derived from yeast or a TEV protease. In certain embodiments, carrier cleaving enzyme is overexpressed. In certain embodiments, the carrier consists of about 469 to 478 amino acids of N-terminal part of the *T. reesei* CBH1 protein GenBank accession No. EGR44817.1.

In one embodiment, the polynucleotide encoding the heterologous glycoprotein (e.g. the antibody) further comprises a polynucleotide encoding CBH1 catalytic domain and linker as a carrier protein, and/or cbh1 promoter.

In certain embodiments, the filamentous fungal cell of the invention overexpress KEX2 protease. In an embodiment the heterologous glycoprotein (e.g. the antibody) is expressed as fusion construct comprising an endogenous fungal polypeptide, a protease site such as a Kex2 cleavage site, and the heterologous protein such as an antibody heavy and/or light chain. Useful 2-7 amino acids combinations preceding Kex2 cleavage site have been described, for example, in Mikosch et al. (1996) J. Biotechnol. 52:97-106; Goller et al. (1998) Appl Environ Microbiol. 64:3202-3208; Spencer et al. (1998) Eur. J. Biochem. 258:107-112; Jalving et al. (2000) Appl. Environ. Microbiol. 66:363-368; Ward et al. (2004) Appl. Environ. Microbiol. 70:2567-2576; Ahn et al. (2004) Appl. Microbiol. Biotechnol. 64:833-839; Paloheimo et al. (2007) Appl Environ Microbiol. 73:3215-3224; Paloheimo et al. (2003) Appl Environ Microbiol. 69:7073-7082; and Margolles-Clark et al. (1996) Eur J Biochem. 237:553-560.

The invention further relates to the glycoprotein, for example an antibody, obtainable or obtained by the method as disclosed above.

In some embodiments the N-glycan glycoform of the glycoprotein or antibody as obtained or obtainable by the method, comprises less than 15%, 10%, 7%, 5%, 3%, 1% or 0.5% (mol %) or is devoid of Hex6 N-glycan. As used herein, the term "Hex6" N-glycan, refers to the Hex6HexNAc2 as shown in FIG. 1.

EXAMPLES

Functional Assays

Assay for Measuring Total Protease Activity of Cells of the Invention

The protein concentrations were determined from supernatant samples from day 2-7 of 1×-7× protease deficient strains (described in WO2013/102674) according to EnzChek protease assay kit (Molecular probes #E6638, green fluorescent casein substrate). Briefly, the supernatants were diluted in sodium citrate buffer to equal total protein concentration and equal amounts of the diluted supernatants were added into a black 96 well plate, using 3 replicate wells per sample. Casein FL diluted stock made in sodium citrate buffer was added to each supernatant containing well and the plates were incubated covered in plastic bag at 37° C. The fluorescence from the wells was measured after 2, 3, and 4 hours. The readings were done on the Varioskan fluorescent plate reader using 485 nm excitation and 530 nm emission. Some protease activity measurements were performed using succinylated casein (QuantiCleave protease assay kit, Pierce #23263) according to the manufacturer's protocol.

The pep1 single deletion reduced the protease activity by 1.7-fold, the pep1/tsp1 double deletion reduced the protease activity by 2-fold, the pep1/tsp1/slp1 triple deletion reduced the protease activity by 3.2-fold, the pep1/tsp1/slp1/gap1 quadruple deletion reduced the protease activity by 7.8-fold compared to the wild type M124 strain, the pep1/tsp1/slp1/gap1/gap2 5-fold deletion reduced the protease activity by 10-fold, the pep1/tsp1/slp1/gap1/gap2/pep4 6-fold deletion reduced the protease activity by 15.9-fold, and the pep1/tsp1/slp1/gap1/gap2/pep4/pep3 7-fold deletion reduced the protease activity by 18.2-fold.

Figure 27:
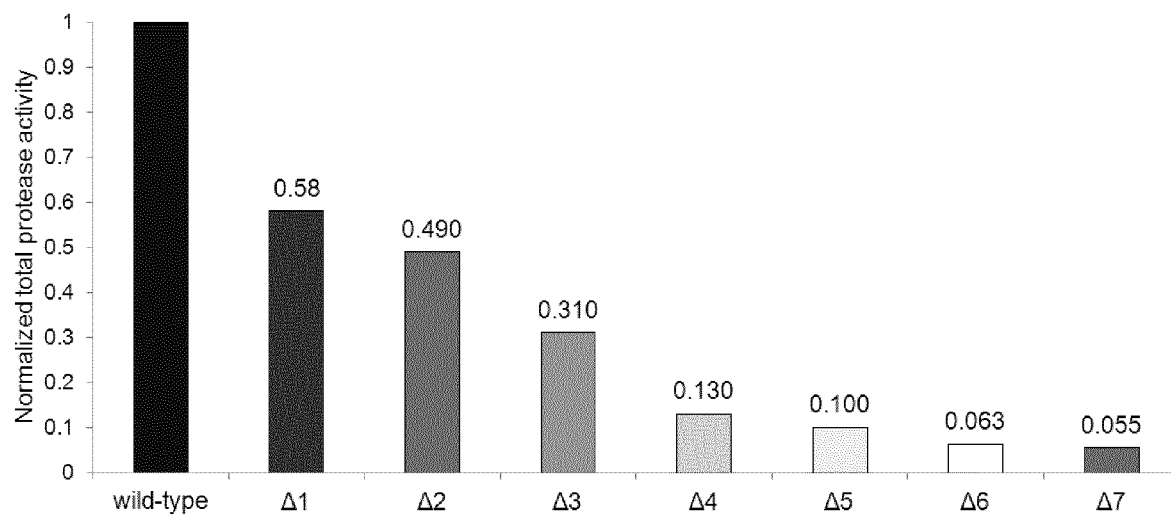
FIG. 27 graphically depicts normalized protease activity data from culture supernatants from each of the protease deletion supernatants (from 1-fold to 7-fold deletion mutant) and the parent strain without protease deletions.

FIG. 27 graphically depicts normalized protease activity data from culture supernatants from each of the protease deletion supernatants (from 1-fold to 7-fold deletion mutant) and the parent strain without protease deletions. Protease activity was measured at pH 5.5 in first 5 strains and at pH 4.5 in the last three deletion strains. Protease activity is against green fluorescent casein. The six-fold protease deletion strain has only 6% of the wild type parent strain and the 7-fold protease deletion strain protease activity was about 40% less than the 6-fold protease deletion strain activity.

Assay for Measuring N-glycosylation Site Occupancy in a Glycoprotein Composition 10-30 μg of antibody is digested with 13.4-30 U of FabRICATOR (Genovis), +37° C., 60 min—overnight, producing one F(ab')2 fragment and one Fc fragment per an antibody molecule. Digested samples are purified using Poros R1 filter plate (Glyken corp.) and the Fc fragments are analysed for N-glycan site occupancy using MALDI-TOF MS. The percentage of site occupancy of an Fc is the average of two values: the one obtained from intensity values of the peaks (single and double charged) and the other from area of the peaks (single and double charged); both the values are calculated as glycosylated signal divided by the sum of non-glycosylated and glycosylated signals.

Example 1

Generation of Rituximab Producing Strains with *T. reesei* Glucosidase 2 Alpha Subunit Overexpression (M384)

This example describes the generation of *T. reesei* strain with the following characteristics:
  it is deficient for alg3 and pep1 protease genes,
  it overexpresses the *Trichoderma reesei* α glucosidase II gene,
  it comprises GnT1 and GnTII recombinant genes.

The resulting strain M384 produces Rituximab with 79.6% G0 glycoforms and 6.9% undesirable Hex6 glycoforms.

Generation of rituximab producing G0 strain M290 of *Trichoderma reesei* (Δalg3, Δpep1) has been described in WO 2012/069593. M279 (of WO 2012/069593) was transformed with plasmid pTTv110, which contain GNT2/1 fusion enzyme targeted to alg3 locus. A clone was designated as M290.

Fermentation and glycan analysis of M290. M290 was fermented in 4% WSG, 4% cellobiose, 6% lactose and 2% glucose, pH 5.2, and sampling was performed at days 3-6. N-glycan analysis was essentially performed as described in the WO 2013/102674. Briefly, rituximab was purified from culture supernatants using Protein G HP MultiTrap 96-well filter plate (GE Healthcare) according to manufacturer's instructions. The antibody concentrations were determined via UV absorbance against antibody standard curve.

N-glycans were released from EtOH precipitated and SDS denatured antibody using PNGase F (ProZyme Inc.) in 20 mM sodium phosphate buffer, pH 7.3, in overnight reaction at +37° C. The released N-glycans were purified with Hypersep C18 and Hypersep Hypercarb (Thermo Scientific) and analysed with MALDI-TOF MS. The result of N-glycan analysis is shown in Table 3 and FIG. 2 that shows MALDI-TOF image of neutral N-glycans released from Rituximab from strain M290 fermented for 5 days. The main glycoform is Hex6. The glycan masses and corresponding structures, as well as used abbreviations are shown in FIG. 1.

TABLE 3

Relative proportions (%) of the predominant neutral N-glycans from purified antibody from strain M290 fermented in WSG medium for 5 days.

| Hex6 | Man3 | GnMan3 | G0 |
|---|---|---|---|
| 72.3 | 8.8 | 0 | 9.8 |

Generation of M325 and M384. Marker removal (pyr4) from Rituximab strain M290 was carried out essentially as described in WO 2013/102674. Consecutive 5-FOA selection steps were carried out to ensure that the clones originated from single cells. Final clones were verified by PCR using the primers listed in Table 4. Removal of the blaster cassette was further verified by plating the clones onto minimal medium plates with or without 5 mM uridine. Resulting pyr4– strain was designated with strain number M325 (clone 4A).

TABLE 4

Primers for screening removal of pyr4 blaster cassette from M290.

| Primer | Sequence |
| --- | --- |
| T044_Cbh1_term_end_F | CCTGGAAAGCACTGTTGGAG (SEQ ID NO: 485) |
| T068_104121_3int | GATTGTCATGGTGTACGTGA (SEQ ID NO: 486) |
| T028_Pyr4_flank_rev | CATCCTCAAGGCCTCAGAC (SEQ ID NO: 487) |

Cloning of *T. reesei* glucosidase 2 alpha subunit. Expression plasmid pTTv161 for *Trichoderma reesei* glucosidase 2 alpha subunit (*T. reesei* gls2α, tre121351) was targeted to follow human GNT2/1 fusion protein (cbh1p-huGNT2/1-cbh1t) construct already in alg3 locus (e.g. strain M325 above). In this construct *T. reesei* GLSIIα is expressed under gpdA promoter and with trpC terminator. Vector contains pyr4 blaster cassette for selection of *T. reesei* transformants.

Expression cassette for *T. reesei* GLSIIα was obtained from a plasmid pTTv86. This plasmid contains *T. reesei* gls2a genomic sequence with 5' and 3'UTR (untranslated regions), gpdA promoter and trpC terminator for expression. It is targeted to alg3 (tre104121) locus and has phosphinothricin N-acetyltransferase (bar) for selection of *T. reesei* transformants (described in WO 2013/102674). Vector backbone is EcoRI-XhoI digested pRS426 (Colot et al., PNAS 2006, 103(27):10352-7). 5' and 3' flanks needed for targeted integration, gls2a, gpdA promoter and trpC terminator were produced by PCR. Template for the flanking fragments and gls2a was wild type *T. reesei* QM6a (ATCC13631). For gpdA promoter and trpC terminator template was a plasmid carrying these *A. nidulans* fragments. Primers used are listed in Table 5. Selection marker (bar) was obtained from the plasmid pTTv41 (described in WO 2013/102674) with NotI digestion. PCR products and digested fragments were separated using agarose gel electrophoresis. Correct fragments were isolated from the gel with a gel extraction kit (Qiagen) essentially according to manufacturer's protocol. The plasmid was constructed with the fragments described above using yeast homologous recombination method as described in WO 2013/102674. Plasmid was rescued from yeast and transformed to *E. coli*. A few clones were selected, plasmid DNA isolated and sequenced. One clone was selected as pTTv86.

TABLE 5

Primers used to produce fragments for cloning GLSIIalpha expression plasmid pTTv86.

| Primer | Sequence |
| --- | --- |
| T262_alg3_5f | GTAACGCCAGGGTTTTCCCAGTCACGACGGTTTAAAC GTTGGGCTGAGGCCGTATCG (SEQ ID NO: 488) |
| T319_104121_5r_gpdA | TTCTTCTTATGATTGATTTGAGCCTGTGTGTAGAGATACAAGG GGCCGGCCGAGAGAGGCAACTCAGGTGA (SEQ ID NO: 489) |
| T085_gpdA_f | CCTTGTATCTCTACACACAGGCTC (SEQ ID NO: 490) |
| T086_gpdA_r | CTGATGTCTGCTCAAGCGGG (SEQ ID NO: 491) |
| T320_gls2_f_gpdA | GCAGCTTGACTAACAGCTACCCCGCTTGAGCAGACATCAGTTAAT TAA AGGCTGCGGACTACTGAATC (SEQ ID NO: 492) |
| T321_gls2_r_trpC | CGTCAAGCTGTTTGATGATTTCAGTAACGTTAAGTGGATCTTAATT AACCTATTCTACGTACAGCATGCAA (SEQ ID NO: 493) |
| T087_trpC_f | GATCCACTTAACGTTACTGAAATCAT (SEQ ID NO: 494) |
| T322_trpC_r_bar | GCCAAGCCCAAAAAGTGCTCCTTCAATATCATCTTCTGTCGCGGC CGCGCGATCGCGGCCGGCCGAGTGGAGATGTGGAGTGGG (SEQ ID NO: 495) |
| T323_104121_3f_bar | CCCGTCACCGAGATCTGATCCGTCACCGGGATCCACTTAA GCGGCCGCGGGCAGTATGCCGGATGGCT (SEQ ID NO: 496) |
| T267_alg3_3r | GCGGATAACAATTTCACACAGGAAACAGCGTTTAAAC ATCTGGCCGAGTACCACCAC (SEQ ID NO: 497) |

For the second expression plasmid the expression cassette for *T. reesei* GLSIIα (gpdAp-gls2a-trpCt) was excised from pTTv86 with FseI+PmeI double digestion. 6.3 kb FseI fragment containing GLSIIa expression cassette and 5.5 kb PmeI fragment containing vector backbone (pRS426) were used for cloning. Other fragments were created by PCR using earlier plasmids as templates. cbh1 terminator was used as 5'integration fragment. For 3'integration alg3 3'flank was used. This fragment contained also pyr4 blaster cassette (with pyr4 5'UTR as repeat). The primers used are listed in Table 6. The digested fragments and PCR products were separated using agarose gel electrophoresis. Correct fragments were isolated from the gel with a gel extraction kit (Qiagen) essentially according to manufacturer's protocol. The plasmid was constructed with the fragments described above using yeast homologous recombination method as described in WO 2013/102674. Plasmid was rescued from yeast and transformed to *E. coli*. A few clones were selected, plasmid DNA isolated and sequenced. One clone was selected as pTTv161.

TABLE 6

Primers used to produce fragments for cloning GLSIIalpha expression plasmid pTTv161.

| Primer | Sequence |
|---|---|
| T126_pTTv86_3'_cbh1term_F | GATTAAGTTGGGTAACGCCAGGGTTTTCCCAGTCACGACGG TTTAAACGACCTACCCAGTCTCACTAC (SEQ ID NO: 498) |
| T127_gpdA_5'_cbh1term_R | TTCTTCTTATTGATTTGAGCCTGTGTGTAGAGATACAAGGGGC CGGCCGGTCCTCGGCTACGTTGTCA (SEQ ID NO: 499) |
| T128_trpC_3'_pyr4_alg3_flank_F | CCTCGTGTACTGTGTAAGCG (SEQ ID NO: 500) |
| T129_trpC_3'_pyr4_alg3_flank_R | TGGAATTGTGAGCGGATAAC (SEQ ID NO: 501) |

Transformation into rituximab G0 strain M325. Plasmid pTTv161 was digested with PmeI to release the fragment for targeted integration and separated with agarose gel electrophoresis. After isolation approximately 5 μg of purified fragment was used to transform protoplasts of Rituximab producing G0 strain M325 (pyr4– of M290). Preparation of protoplasts and transformation were carried out essentially as described in WO 2013/102674 using pyr4 selection. Transformants were streaked onto selective plates. Growing clones were screened for correct integration by PCR using primers listed in Table 7. Clones giving expected signals were purified to single cell clones and rescreened for correct integration and clone purity by PCR using primers listed in Table 7. After shake flask cultivation one clone was designated with number M384 (clone #22-4A).

TABLE 7

Primers used in screening correct integration of pTTv161 to M325 and clone purity.

| Primer | Sequence |
|---|---|
| T089_Tdm_seq_4F | TCATCAAGCTGAACCAGCAG (SEQ ID NO: 728) |
| T018_pgpdA_5rev | GAGCAGGCTCGACGTATTTC (SEQ ID NO: 729) |
| T068_104121_3int | GATTGTCATGGTGTACGTGA (SEQ ID NO: 730) |

TABLE 7-continued

Primers used in screening correct integration of pTTv161 to M325 and clone purity.

| Primer | Sequence |
|---|---|
| T028_Pyr4_flank_rev | CATCCTCAAGGCCTCAGAC (SEQ ID NO: 731) |
| T088_104121_3rc_pcr | ATGATGACTCCAGGCCAAAG (SEQ ID NO: 732) |

Figure 3:
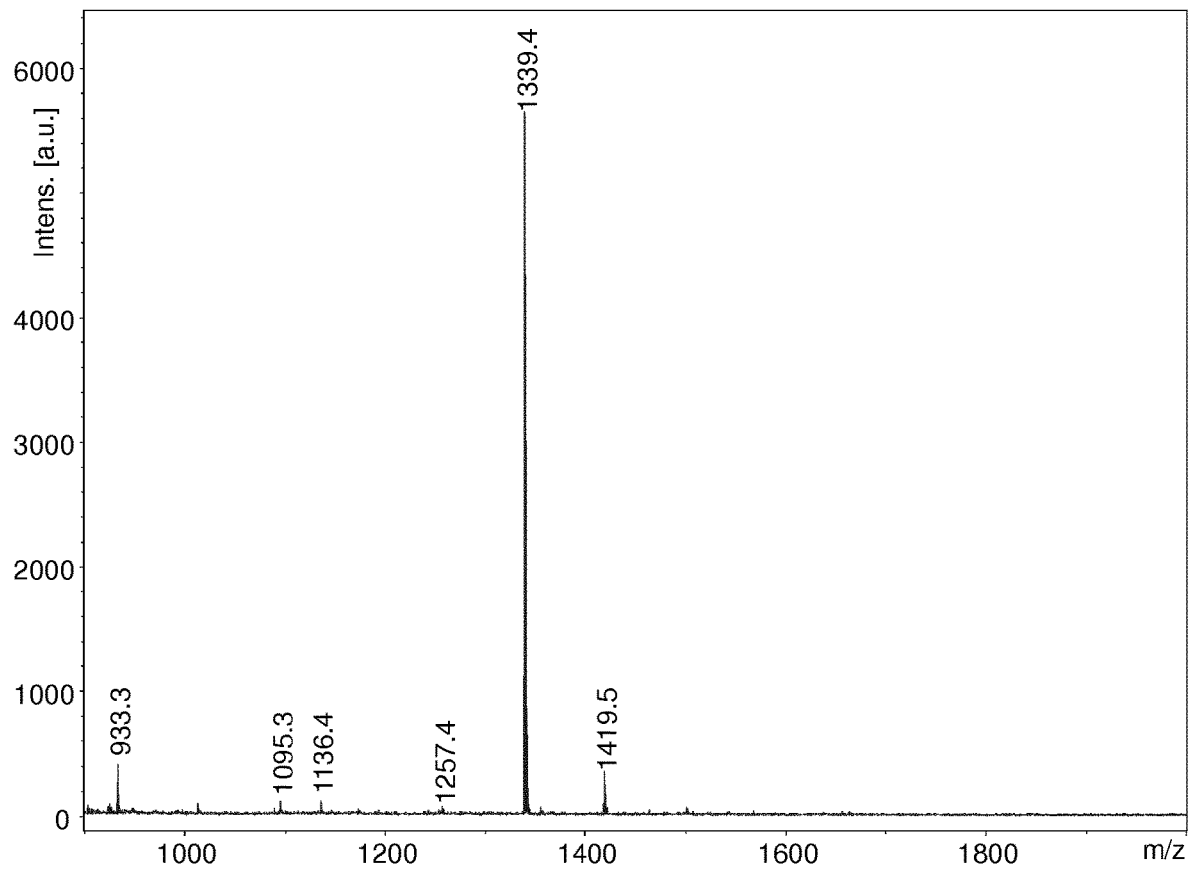
FIG. 3. MALDI-TOF MS image of neutral N-glycans released from MAB01 from strain M384 fermented for 3 days.

Fermentation and glycan analysis of M384. M384 was fermented in 4% WSG, 4% cellobiose, 6% lactose and 2% glucose, pH 5.2, and sampling was performed at days 3-11. N-glycan analysis was performed as described above and the results are shown in Table 8. The GLSIIα expression has reduced the Hex6 level to 6.9% and the main glycoform is G0 with 79.6% share at day 3. FIG. 3 shows MALDI-TOF image of the fermented M384 neutral N-glycans from day 3.

TABLE 8

Relative proportions (%) of the predominant neutral N-glycans from purified antibody from strain M384 fermented in WSG medium.

| | Hex6 | Man3 | GnMan3 | G0 |
|---|---|---|---|---|
| Day 3 | 6.9 | 8.7 | 0 | 79.6 |
| Day 5 | 15.4 | 11.8 | 0 | 62.1 |

It is remarkable that overexpression of *T. reesei* glucosidase IIα gene resulted in a significant increase of G0 glycoforms of rituximab as compared to undesirable Hex6 glycoforms.

Example 2

Generation of Strains M1057 and M1058 Expressing *Trypanosoma congolense* Glucosidase IIα and Rituximab This example describes the generation of *T. reesei* strain with the following characteristics:
  it is deficient for alg3 and pep1 genes,
  it overexpresses the *T. reesei* glucosidase 2a gene together with the *T. congolense* glucosidase 2α gene,
  it overexpresses the *T. reesei* α1,2 mannosidase gene
  it comprises GnTI and GnTII recombinant genes.
The resulting strains 1057/1058 produce Rituximab with 81.7% G0 glycoform and only 1% of undesirable Hex6 glycoform.

Generation of pyr4− of M384 (M555). Marker removal (pyr4) from GNT2/1+GLSIIα expressing rituximab strain M384 was carried out essentially as described in WO 2013/102674. Consecutive 5-FOA selection steps were carried out to ensure that the clones originated from single cells. Final clones were verified by PCR using the primers listed in Table 9. Removal of the blaster cassette was further verified by plating the clones onto minimal medium plates with or without 5 mM uridine. Resulting pyr4− strain was designated with strain number M555 (clone 2A-a).

TABLE 9

Primers for screening removal of pyr4 blaster cassette from M384.

| Primer | Sequence |
| --- | --- |
| T047_trpC_term_end_F | CCTATGAGTCGTTTACCCAGA (SEQ ID NO: 502) |
| T088_104121_3rc_pcr | ATGATGACTCCAGGCCAAAG (SEQ ID NO: 503) |
| T060_pyr4_orf_screen_1F | TGACGTACCAGTTGGGATGA (SEQ ID NO: 504) |

Strains M1057 and M1058 were generated by transforming the M555 with split marker vectors pTTg214i (pcDNA-(CBHI) *T. congolense* Glucosidaseiiα-tEgl2-first half of pyr4 marker) and pTTg215i (second half of pyr4 marker-pCDNA-*T. reesei* ManI HDEL-tTrpC) targeted to xylanase I locus of *T. reesei*. Vectors were constructed by yeast recombination, using PCR amplified fragments from previously described vectors pTTv183, pTTv224, pTTv225 and pTTv351. Synthetic *Trypanosoma congolense* Glucosidase II α-subunit gene was ordered from commercial supplier and amplified from the vector stock provided by the supplier. Vector backbone was EcoRI-XhoI digested pRS426 (Colot et al., PNAS 2006, 103(27):10352-7). Fragments and PCR primers are described on Table 10 below.

TABLE 10

| pTTg214 intermediate | Backbone | pRS426 EcoRI/XhoI |
| --- | --- | --- |
| | Xylanase 5' flank | PCR product; primers T184/T185 |
| | pcDNA promoter | PCR product; primers GP687/T738 |
| | *Trypanosoma congolense* Glucosidase II α | PCR product; primers GP693/GP695 |
| | Egl2 terminator | PCR product; primers GB686/T759 |
| | First half of Pyr4 marker | PCR product; primers GP688/T1354 |
| pTTg215 intermediate | Backbone | pRS426 EcoRI/XhoI |
| | Second half of Pyr4 marker | PCR product; primers T1355/T763 |
| | Loopout fragment (from tEgl2) + pcDNA promoter | PCR product; primers T1356/T738 |
| | *Trichoderma reesei* ManI with HDEL TrpC terminator | PCR product; primers T1272/T1276 |
| | Xylanase 3' flank | PCR product; primers GP681/GP682 |
| | | PCR product; primers GP683/T196 |

T184
(SEQ ID NO: 505)
TAAGTTGGGTAACGCCAGGGTTTTCCCAGTCACGACGTTTAAACCAAGTC

TTCGTACTCTATCG

T185
(SEQ ID NO: 506)
GATGATTATTTGTGCGTGTT

GP687
(SEQ ID NO: 507)
TATCGACTTCAAGGAAAACACGCACAAATAATCATCGGTCTGAAGGACGT

GGAATGATGG

T738
(SEQ ID NO: 508)
GTTGAGAGAAGTTGTTGGATTGATCA

GP693
(SEQ ID NO: 509)
CAACCAAAGACTTTTTGATCAATCCAACAACTTCTCTCAACTTAATTAAA

TGTATCGGAAGTTGGCCG

GP695
(SEQ ID NO: 510)
AGATACAAACGTTGGCGAGGCTTCTGCATTCAGCTCAGAGTGGGCCGGCC

TCACTTCTTGAGGACGATG

GP686
(SEQ ID NO: 511)
GGCCGGCCCACTCTGAGCTGAATGCAGAAGCCTCGCCAAC

T759
(SEQ ID NO: 512)
TACAATAACACAGATCTTTTATGACGG

GP688
(SEQ ID NO: 513)
GTAATGTTCTACCGTCATAAAAGATCTGTGTTATTGTAGCGATCGCCTAG

CATCGACTACTGCTGCTC

T1354
(SEQ ID NO: 514)
GCGGATAACAATTTCACACAGGAAACAGCGTTTAAACGCGGCCGCCTCCA

CCGACCGATCCGTTGG

T1355
(SEQ ID NO: 515)
GTAACGCCAGGGTTTTCCCAGTCACGACGGTTTAAACGCGGCCGCTCAAG

CTCATGGACCTCAAGGC

T763
(SEQ ID NO: 516)
CCATGCAAAGATACACATCAATCG

T1356
(SEQ ID NO: 517)
GATTGTACCCCAGCTGCGATTGATGTGTATCTTTGCATGGGCGGCCGCGG

CATCCGTAGTTGTCGCAAGA

T738
(SEQ ID NO: 518)
GTTGAGAGAAGTTGTTGGATTGATCA

T1272
(SEQ ID NO: 519)
AACCAAAGACTTTTTGATCAATCCAACAACTTCTCTCAACATGAGATTCC

CTAGCAGCTC

T1276
(SEQ ID NO: 520)
CGTCAAGCTGTTTGATGATTTCAGTAACGTTAAGTGGATCTTAGAGCTCG

TCGTGAGCAAGGTGGCCGCCCCGTC

-continued

GP681
(SEQ ID NO: 521)
GATCCACTTAACGTTACTGAAATCATCAAACAGCTTGACGAATCTG

GP682
(SEQ ID NO: 522)
TCACTAACCACCCCAATACTACATACCAGCTCAAACCCCTGGCCGGCCGA

GTGGAGATGTGGAGTGG

GP683
(SEQ ID NO: 523)
CACTCGGCCGGCCAGGGGTTTGAGCTGGTATGTAGTATTGGGGTGGTTAG

TGAGTTAAC

T196
(SEQ ID NO: 524)
ATTGTGAGCGGATAACAATTTCACACAGGAAACAGCGTTTAAACTCTCGG

CGCTTGTCAATGTT

Plasmids pTTg214i and pTTg215i were digested with PmeI to release the fragment for targeted integration and separated with agarose gel electrophoresis. Approximately 5 µg purified fragment was used to transform protoplasts of Rituximab producing G0 strain M555 (pyr4– of M384) using pyr4 selection as described above. Transformants were streaked onto selective plates. Growing clones were screened for correct integration by PCR using primers listed in Table 11. Clones giving expected signals were purified to single cell clones and rescreened for correct integration and clone purity by PCR using primers listed in Table 11. After shake flask cultivation, two clones were selected and designated with numbers M1057 (clone #45A) and M1058 (clone #80A).

TABLE 11

| | | |
|---|---|---|
| 5' Integration | GP193 | ATGTTGAGAGAAGTTGTTGGATTGATC AAAAAG (SEQ ID NO: 525) |
| | GP804 | CCGCGTTGAACGGCTTCCCA (SEQ ID NO: 526) |
| 3' Integration | GP469 | GAATCCGCTCTTGGCTCCAC (SEQ ID NO: 527) |
| | GP805 | GCGACGGCGACCCATTAGCA (SEQ ID NO: 528) |
| Locus | GP806 | TGCGCTCTCACCAGCATCGC (SEQ ID NO: 529) |
| | GP811 | CCACTCCAAGTCAACATCAA (SEQ ID NO: 530) |

Figure 4:
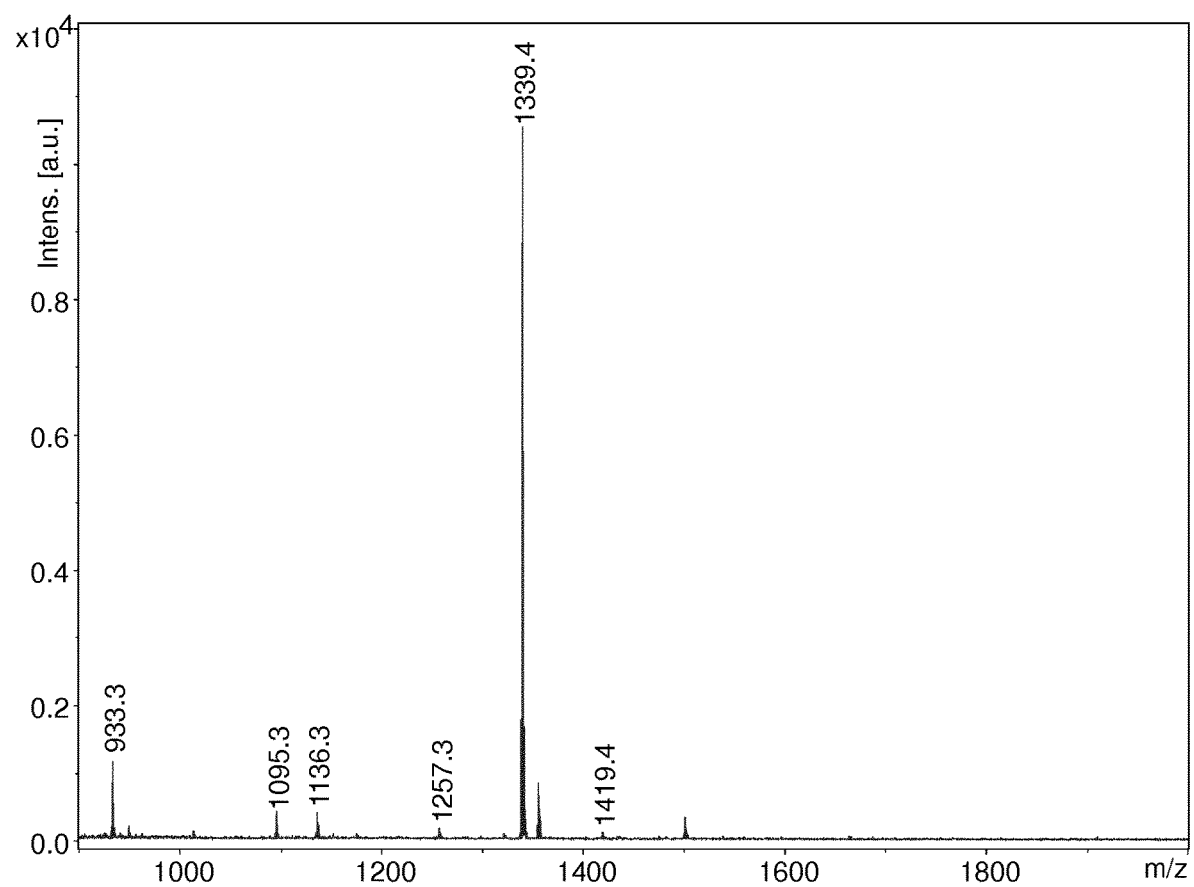
FIG. 4. MALDI-TOF MS image of neutral N-glycans released from MAB01 from strain M1057 fermented for 5 days.
Figure 5:
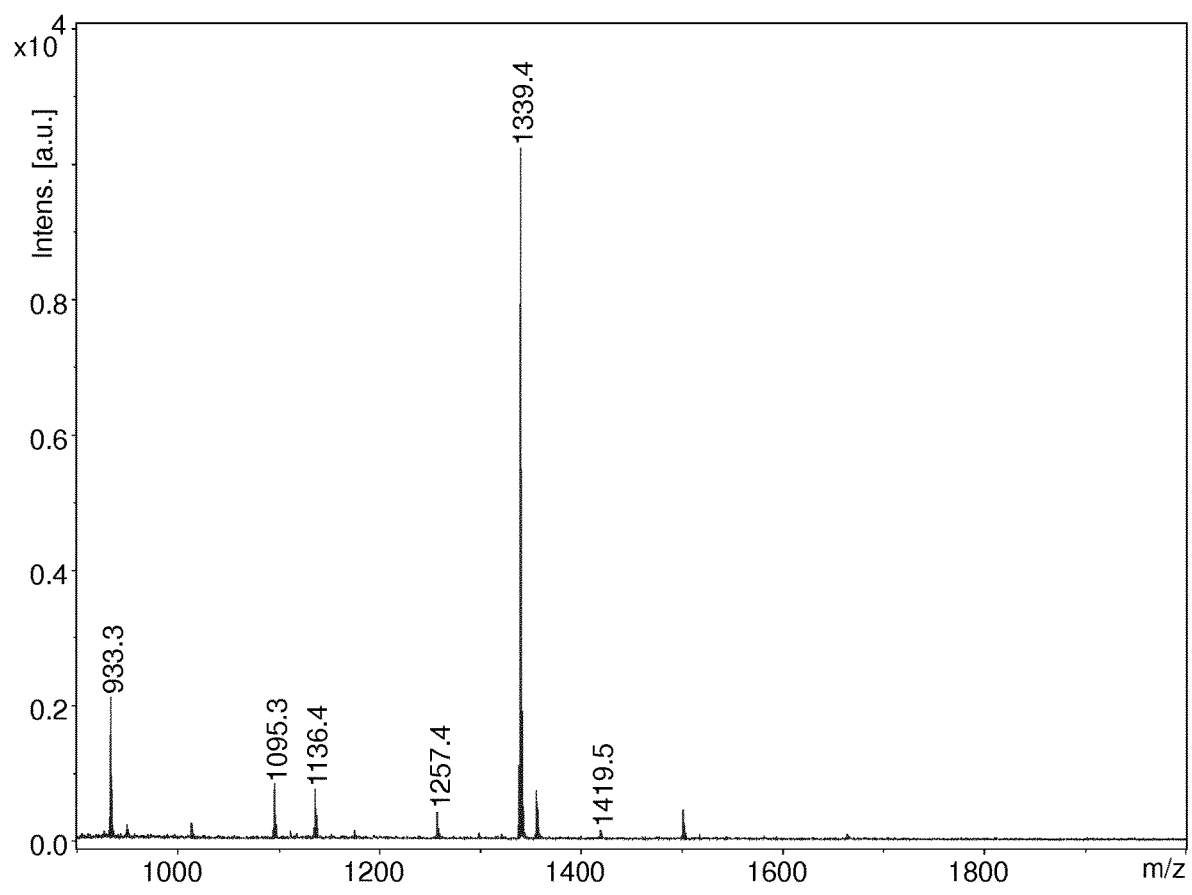
FIG. 5. MALDI-TOF MS image of neutral N-glycans released from MAB01 from strain M1058 fermented for 5 days.

Fermentation and glycan analysis of M1057 and M1058. Strains M1057 and M1058 were fermented in 4% WSG, 2% glucose, 4% cellobiose, 6% lactose. Sampling was performed at days 3-6 and the N-glycan analysis was performed as described above. The results are shown in Table 12. The double expression of GLSIIα from *T. reesei* and *T. congolense* has reduced the Hex6 level to 1% in strain M1057 and the overexpression of *T. reesei* ManI-HDEL has increased the G0 amount to 81.7%. FIGS. 4 and 5 show MALDI-TOF images of the fermented M1057 and M1058 neutral N-glycans from day 5, respectively.

TABLE 12

Relative proportions (%) of the predominant neutral N-glycans from purified antibody from strains M1057 and M1058 fermented in WSG medium for 5 days.

| | Hex6 | Man3 | GnMan3 | G0 |
|---|---|---|---|---|
| M1057 | 1.0 | 9.2 | 3.2 | 81.7 |
| M1058 | 1.1 | 14.6 | 5.3 | 70.2 |

Example 3

Generation of Strains M1128-M1130 (FG0 on Rituximab)

This example describes the generation of *T. reesei* strain with the following characteristics:
it is deficient for alg3 and pep1 genes,
it overexpresses the *T. reesei* glucosidase 2α gene,
it comprises GnTI and GnTII recombinant genes;
it comprises GMD, FX and FUT8 genes for fucosylation of the glycoforms.

The resulting strains 1128/1130 produce rituximab with 39.5% FG0 glycoform and 12.4% of undesirable Hex6 glycoform.

PmeI fragments of pTTv224 and pTTv225 plasmids were co-transformed to the strain M555 and the strain generated as described in the Example 2 of WO2013/174927.

Figure 6:
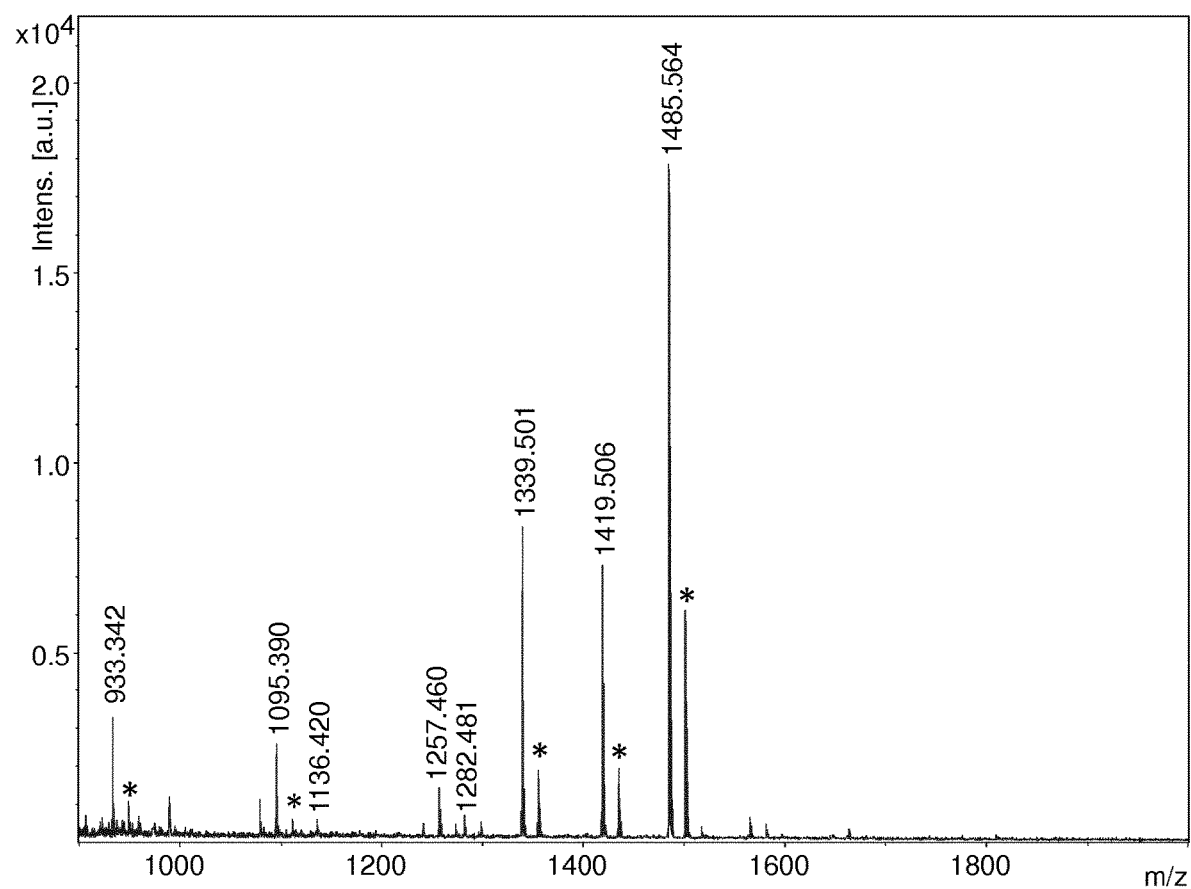
FIG. 6. MALDI-TOF MS image of neutral N-glycans released from Rituximab from fucosylation strain M1128 fermented for 5 days. K$^+$ adducts marked with asterisk.

Fermentation and glycan analysis. The strains M1128 and M1130 were fermented in 4% WSG, 2% glucose, 4% cellobiose, 6% lactose, pH 5.5, and sampling was performed at days 3-6. N-glycan analysis was performed as above. The results are shown in Table 13. In the strains M1128 and M1130 FG0 levels ranged from 14.9% to 39.5%. The highest FG0 level, signal m\z 1485 [M+Na]$^+$ in mass spectrum (FIG. 6), was reached at day 5 in strain M1128.

TABLE 13

Relative proportions of neutral N-glycans from purified antibody from strains M1128 and M1130 fermented in WSG medium. Sampling at days 3-6.

| | | | M1128 | | | | M1130 | | | |
|---|---|---|---|---|---|---|---|---|---|---|
| Composition | Short | m\z | d3 % | d4 % | d5 % | d6 % | d3 % | d4 % | d5 % | d6 % |
| Hex3HexNAc2 | Man3 | 933.31 | 12.3 | 8.0 | 7.2 | 9.8 | 12.1 | 7.9 | 13.3 | 18.0 |
| Hex3HexNAc2dHex | FMan3 | 1079.38 | 0.0 | 2.9 | 2.5 | 2.1 | 0.0 | 1.4 | 1.3 | 1.8 |
| Hex4HexNAc2 | Man4 | 1095.37 | 9.3 | 4.9 | 5.1 | 9.3 | 0.0 | 3.5 | 8.7 | 9.3 |
| Hex3HexNAc3 | GnMan3 | 1136.40 | 0.0 | 2.2 | 1.3 | 1.4 | 0.0 | 1.6 | 1.6 | 2.1 |
| Hex5HexNAc2 | Man5 | 1257.42 | 7.4 | 4.4 | 2.9 | 4.4 | 0.0 | 3.0 | 4.5 | 4.5 |
| Hex3HexNAc3dHex | FGnMan3 | 1282.45 | 0.0 | 1.9 | 1.6 | 0.9 | 0.0 | 1.0 | 0.8 | 1.0 |
| Hex3HexNAc4 | G0 | 1339.48 | 20.1 | 18.0 | 18.4 | 17.6 | 31.5 | 30.1 | 22.2 | 18.0 |
| Hex6HexNAc2 | Hex6 | 1419.48 | 22.2 | 17.2 | 16.1 | 21.4 | 18.9 | 12.4 | 20.3 | 25.7 |
| Hex3HexNAc4dHex | FG0 | 1485.53 | 26.1 | 33.5 | 39.5 | 27.3 | 34.8 | 34.2 | 21.9 | 14.9 |
| Hex4HexNAc4 | H4N4 | 1501.53 | 2.5 | 3.6 | 3.2 | 3.8 | 2.7 | 4.0 | 3.9 | 3.1 |

TABLE 13-continued

Relative proportions of neutral N-glycans from purified antibody from strains M1128 and M1130 fermented in WSG medium. Sampling at days 3-6.

| Composition | Short | m\z | M1128 d3 % | M1128 d4 % | M1128 d5 % | M1128 d6 % | M1130 d3 % | M1130 d4 % | M1130 d5 % | M1130 d6 % |
|---|---|---|---|---|---|---|---|---|---|---|
| Hex6HexNAc2dHex | FHex6 | 1565.53 | 0.0 | 2.1 | 1.4 | 1.4 | 0.0 | 0.0 | 0.7 | 0.8 |
| Hex7HexNAc2 | Hex7 | 1581.53 | 0.0 | 1.2 | 0.7 | 0.7 | 0.0 | 1.0 | 0.7 | 0.8 |

Example 4

Generation of MAB01 Producing Strain M908 with A. niger Glucosidase II α- and β-Subunits This example describes the generation of T. reesei strain with the following characteristics:
- it is deficient for alg3 and pep1, tsp1, slp1, gap1, gap2, pep4, pep3 genes,
- it overexpresses the A. niger glucosidase 2 α subunit encoding gene together (with HDEL) and β-subunit encoding gene, The resulting strains M908 produces Rituximab with 79.1 Man3 glycoform and only 3.3% of undesirable Hex6 glycoform.

The coding sequences of the Aspergillus niger glucosidase II α- and β-subunits were cloned from strain ATCC 1015 DNA. The cloning was made in two steps, first the α- and β-subunits were cloned and sequenced separately, and then the β-subunit was inserted to the plasmids carrying the α-subunit. One plasmid for integration into the alg3 locus and one with xylanase 1 flanks were cloned.

The plasmid with alg3 flanks and Aspergillus niger glucosidase II α-subunit was cloned using yeast homologous recombination and, as vector backbone, the yeast vector pRS426, EcoRI-XhoI digested, was used (Colot et al., PNAS 2006, 103(27):10352-7). The alg3 5' and 3' flanks were created by PCR from a plasmid targeted to the alg3 locus (pTTv110, from PCT/EP2011/070956). The cbh1 promoter and cbh2 terminator were obtained by PCR, using plasmids containing the cbh1 sequences. The Aspergillus niger glucosidase II α-subunit was also obtained by PCR, using ATCC 1015 genomic DNA. An ER-retention signal (HDEL) was created with the reverse PCR primer. A double pyr4-hygromycin marker was obtained by NotI digestion of plasmid pTTv194 (from WO2013/102674 and WO 2013/174927). The primers used are listed in Table 14. The digested fragment and PCR products were separated with agarose gel electrophoresis and the correct fragments were isolated from the gel with a gel extraction kit (Qiagen) according to manufacturer's protocol. The plasmid DNA was rescued from yeast and transformed into electro competent TOP10 E. coli that were plated on ampicillin (100 µg/ml) selection plates. Miniprep plasmid preparations were made from several colonies. The presence of the Aspergillus niger glucosidase II α-subunit gene was confirmed by digesting the prepared plasmids with PvuI and two positive clones were sequenced to verify the sequence (Table 15). One correct clone was chosen to be the final vector pTTv345.

The plasmid with Aspergillus niger glucosidase II α-subunit targeted to the xylanase 1 locus was cloned as described for the pTTv345 plasmid, with the difference that the xyn1 5' and 3' flanks were created by PCR from a plasmid targeted to the xyn1 locus (pTTv183) and that the final vector was named pTTv346. The primers used are listed in Table 14 and Table 15. The 5' and 3' flank sequences of xyn1 in the cassette used for integration are shown in SEQ ID NO:461 and SEQ ID NO:462.

The Aspergillus niger glucosidase II β-subunit was cloned to an intermediate expression vector carrying cbh1 promoter and terminator (pTTv261). The plasmid was digested with PacI-FseI and thereby releasing the cbh1 promoter. The cbh1 promoter and egl2 terminator were obtained by PCR, using plasmids containing the sequences. The Aspergillus niger glucosidase II β-subunit was also obtained by PCR, using ATCC 1015 genomic DNA. The primers used are listed in Table 14 and Table 15. The cloning was carried out as described for plasmid pTTv345. The resulting plasmid was named pTTv347 and contains two terminators.

The second step of the cloning was performed to insert the β-subunit to the plasmids carrying the α-subunit. pTTv345 and pTTv346 plasmids were linearised with PacI and the β-subunit, together with the cbh1 promoter and egl2 terminator, was digested from pTTv347 plasmid with PacI. The new plasmids were constructed using the yeast homologous recombination method, using overlapping oligonucleotides for the recombination of the β-subunit fragment. The primers used are listed in Table 14. The cloning was carried out as described for plasmid pTTv345, with the exception that the prepared plasmids were digested with SacII and the plasmids were sequenced only to confirm correct recombination (Table 15). The plasmid with alg3 flanks was named pTTv348 and the plasmid with xyn1 flanks pTTv349.

TABLE 14

List of primers used for cloning vectors pTTv345, pTTv346, pTTv347, pTTv348 and pTTv349.

| Fragment | Primer | Primer sequence |
|---|---|---|
| alg3 5'flank | T262_alg3_5f | GTAACGCCAGGGTTTTCCCAGTCACGACGGTTTAAAC GTTGGGCTGAGGCCGTATCG (SEQ ID NO: 531) |
|  | T1278_pTTv345_1 | TGGTGTTTGAATAGATTGTCTCTGGCCTCTTGTTGCC ACAGGCCGGCCGCGATCGCGAGAGAGGCAACTCAG GTGAG (SEQ ID NO: 532) |

TABLE 14-continued

List of primers used for cloning vectors pTTv345, pTTv346, pTTv347, pTTv348 and pTTv349.

| Fragment | Primer | Primer sequence |
| --- | --- | --- |
| cbh1 promoter | T1279_pTTv345_2 | TGTGGCAACAAGAGGCCAGAG (SEQ ID NO: 533) |
| | T977_promf rev | GATGCGCAGTCCGCGGTTGA (SEQ ID NO: 534) |
| A. niger GLSII α-subunit | T1280_pTTv345_3 | GAGGCACAGAAACCCAATAGTCAACCGCGGACTGCG CATCATGTCCAACCGTTGGACCCTACT (SEQ ID NO: 535) |
| | T1281_pTTv345_4 | CTACAGCTCGTCGTGAAACTCAATCCGCCATGTCTTT CC (SEQ ID NO: 536) |
| cbh2 terminator | T1282_pTTv345_5 | TGGAAAGACATGGCGGATTGAGTTTCACGACGAGCT GTAGGGCTTTCGTGACCGGGCTTCA (SEQ ID NO: 537) |
| | T1283_pTTv345_6 | GCCGCAGCCTCAGCCTCTCTCAGCCTCATCAGCCGC GGCCGCGCGATCGCTTAATTAAGGCCGGCCGTATCA GTCAGCGAGCAAGCCA (SEQ ID NO: 538) |
| alg3 3'flank | T1284_pTTv345_7 | GCTGGCAACGAGAGCAGAGCAGCAGTAGTCGATGCT AGGCGGCCGCGGGCAGTATGCCGGATGGC (SEQ ID NO: 539) |
| | T267_alg3_3r | GCGGATAACAATTTCACACAGGAAACAGCGTTTAAAC ATCTGGCCGAGTACCACCAC (SEQ ID NO: 540) |
| xyn1 5'flank | T184_Xyn1_5'_flank_Fw | TAAGTTGGGTAACGCCAGGGTTTTCCCAGTCACGAC GTTTAAACCAAGTCTTCGTACTCTATCG (SEQ ID NO: 541) |
| | T1285_pTTv346_1 | TGGTGTTTGAATAGATTGTCTCTGGCCTCTTGTTGCC ACAGGCCGGCCGCGATCGCGATGATTATTTGTGCGT GTTTTCC (SEQ ID NO: 542) |
| xyn1 3'flank | T1286_pTTv346_2 | GCTGGCAACGAGAGCAGAGCAGCAGTAGTCGATGCT AGGCGGCCGCAGGGGTTTGAGCTGGTATGTAG (SEQ ID NO: 543) |
| | T196_Xyn1_3'_flank_Rev | ATTGTGAGCGGATAACAATTTCACACAGGAAACAGCG TTTAAACTCTCGGCGCTTGTCAATGTT (SEQ ID NO: 544) |
| cbh1 promoter | T1287_pTTv347_1 | TTATTCACACTCTCAGAATAAATTCATCGCCAATTTGA CAGGCCGGCCTTAATTAATGTGGCAACAAGAGGCCA GAG (SEQ ID NO: 545) |
| | T977_promf rev | GATGCGCAGTCCGCGGTTGA (SEQ ID NO: 546) |
| A. niger GLSII β-subunit | T1288_pTTv347_2 | GAGGCACAGAAACCCAATAGTCAACCGCGGACTGCG CATCATGATACTTCCTCAGGGATCGCTC (SEQ ID NO: 547) |
| | T1289_pTTv347_3 | TCACAGCTCATCCTTGCGGTTCG (SEQ ID NO: 548) |
| egl2 terminator | T1290_pTTv347_4 | TGAGGGCGCAACTGCCCCGAACCGCAAGGATGAGCT GTGACACTCTGAGCTGAATGCAGAAG (SEQ ID NO: 549) |
| | T1291_pTTv347_5 | ATACCGCCGCACTGGCCGTAGTGAGACTGGGTAGGT CTTAATTAATACAATAACACAGATCTTTTATGAC (SEQ ID NO: 550) |
| A. niger GLSII β-subunit 5' overlapping oligos | T1349_pTTv348_1 | AGAAATGGCTTGCTCGCTGACTGATACGGCCGGCCT TAATTAATGTGGCAACAAGAGGCCAGAGACAATCTAT TCAAACACCA (SEQ ID NO: 551) |
| | T1350_pTTv348_2 | TGGTGTTTGAATAGATTGTCTCTGGCCTCTTGTTGCC ACATTAATTAAGGCCGGCCGTATCAGTCAGCGAGCA AGCCATTTCT (SEQ ID NO: 552) |
| A. niger GLSII β-subunit 3' overlapping oligos | T1351_pTTv348_3 | GTAATGTTCTACCGTCATAAAAGATCTGTGTTATTGTA TTAATTAAGCGATCGCGCGGCCGCGGCTGATGAGGC TGAGAGAGGCTG (SEQ ID NO: 553) |
| | T1352_pTTv348_4 | CAGCCTCTCTCAGCCTCATCAGCCGCGGCCGCGCGA TCGCTTAATTAATACAATAACACAGATCTTTTATGACG GTAGAACATTAC (SEQ ID NO: 554) |

TABLE 15

List of primers used for sequencing vectors pTTv345, pTTv346, pTTv347, pTTv348 and pTTv349.

| Primer | Sequence |
| --- | --- |
| T023_pRS426_5.1sekv | GGCGAAAGGGGGATGTGCTG (SEQ ID NO: 555) |
| T024_pRS426_3.1sekv | CACTTTATGCTTCCGGCTCC (SEQ ID NO: 556) |
| T038_Cbh1_promoter_F | CATCTTTTGAGGCACAGAA (SEQ ID NO: 557) |
| T043_Cbh1_term_R | TCATGATACGGGCTCACCAAG (SEQ ID NO: 558) |
| T160_tcbh2_seq_f1 | GCGATGGTGTGGTTCCCGGT (SEQ ID NO: 559) |
| T161_tcbh2_seq_f2 | CAGCTGCGGAGCATGAGCCT (SEQ ID NO: 560) |
| T591_egl2_5'flank_F2 | CCGGCAACTCAGACCTACAG (SEQ ID NO: 561) |
| T805 | TGTAACTCAGGTTAATTGTTGGGC (SEQ ID NO: 562) |
| T816 | GGAGCATGAGCCTATGG (SEQ ID NO: 563) |
| T1339_AnGLSII | CAACCGTTGGACCCTACTGC (SEQ ID NO: 564) |
| T1340_AnGLSII | CCTTTAGCGCCGACTTCAAGAG (SEQ ID NO: 565) |
| T1341_AnGLSII | CACCACTGACACCCAGAGTC (SEQ ID NO: 566) |
| T1342_AnGLSII | GCCATCAAATGGTGGGTCAG (SEQ ID NO: 567) |
| T1343_AnGLSII | GAGAGCCGTATCTGATTGCC (SEQ ID NO: 568) |
| T1344_AnGLSII | GAGACGTTCGACTATAAGCG (SEQ ID NO: 569) |
| T1345_AnGLSII | ATGATACTTCCTCAGGGATCG (SEQ ID NO: 570) |
| T1346_AnGLSII | GGAGAAGAGACAGAAGTCCA (SEQ ID NO: 571) |
| T1347_AnGLSII | CGGGCATCAACTGGGAACAG (SEQ ID NO: 572) |
| T1348_AnGLSII | GTCACTCTTCAGTACGCCAACG (SEQ ID NO: 573) |
| T1359_xyn15_for | TACGAGCCGCTTTCAACCTC (SEQ ID NO: 574) |
| T1360_xyn13_rev | GGCTACTTTAGTTACATGACAGCA (SEQ ID NO: 575) |
| T1361_alg35_for | TTTCACGCGCATCTTCATCG (SEQ ID NO: 576) |
| T1362_agl33_rev | TCCAATGTGGGAAAGCTGCC (SEQ ID NO: 577) |
| T1380_GLSIIalpha_rev | GGATGAGTCGAGTTCGTATGGG (SEQ ID NO: 578) |
| T1381_GLSIIbeta_rev | CAGTAATCATCGTTCACGGCG (SEQ ID NO: 579) |
| T1382_GLSIIbeta | GAAGGGAATCACGAAGAGCC (SEQ ID NO: 580) |
| T1394_AnGLSII | AAACCGCGACCTTGAGACC (SEQ ID NO: 581) |
| T1395_AnGLSII | CGAGAGTGTGGGATTGGATATCAC (SEQ ID NO: 582) |
| T1396_AnGLSII | GCACCAAGTGTGAAGACAAGTG (SEQ ID NO: 583) |
| T1397_AnGLSII | TGGAATACAACCCTAACTTCAACG (SEQ ID NO: 584) |
| cbh1prom-FW | GCAAAGCCCCACTTCCCCACGTT (SEQ ID NO: 585) |
| CbhI prom 5' sekv | CAACTCAGATCCTCCAGGAGAC (SEQ ID NO: 586) |

Transformation into *T. reesei* strain. To prepare the vector for transformation, the pTTv348 vector was cut with PmeI to release the expression cassette. The fragments were separated with agarose gel electrophoresis and the purified expression cassette DNA (5 μg) was then transformed into protoplasts of the *Trichoderma reesei* M564 strain expressing MAB01 (see WO2013/102674). The transformed protoplasts were plated onto *Trichoderma* minimal media (TrMM) plates containing sorbitol and hygromycin. Transformants were then streaked onto TrMM plates with 0.1% TritonX-100 and hygromycin. Transformants growing fast as selective streaks were screened by PCR using the primers listed in Table 16. DNA from mycelia was purified and analyzed by PCR to look at the integration of the 5' and 3' flanks of cassette and the existence of the alg3 ORF. The cassette was targeted into the alg3 locus; therefore the open reading frame was not present in the positively integrated transformants, purified to single cell clones. To screen for 5' integration, sequence outside of the 5' integration flank was used to create a forward primer that would amplify genomic DNA flanking alg3 and the reverse primer was made from sequence in the cbh1 promoter of the cassette. To check for proper integration of the cassette in the 3' flank, a reverse primer was made from sequence outside of the 3' integration flank that would amplify genomic DNA flanking alg3 and the forward primer was made from sequence in the pyr4-hygromycin marker.

TABLE 16

List of primers used for PCR screening of pTTv348 T. reesei transformants.

| 5' flank screening primers: | 1241 bp product |
|---|---|
| T066_104121_5int | GATGTTGCGCCTGGGTTGAC (SEQ ID NO: 733) |
| T176_pcbh1_seq_r4 | CTCCGGGTTCGCAGCAGCTT (SEQ ID NO: 734) |
| 3' flank screening primers: | 1461 bp product |
| T026_Pyr4_orf_5rev2 | CCATGAGCTTGAACAGGTAA (SEQ ID NO: 735) |
| T068_104121_3int | GATTGTCATGGTGTACGTGA (SEQ ID NO: 736) |
| alg3 ORF primers: | 690 bp product |
| T767_alg3_del_F | CAAGATGGAGGGCGGCACAG (SEQ ID NO: 737) |
| T768_alg3_del_R | GCCAGTAGCGTGATAGAAGC (SEQ ID NO: 738) |

Figure 7:
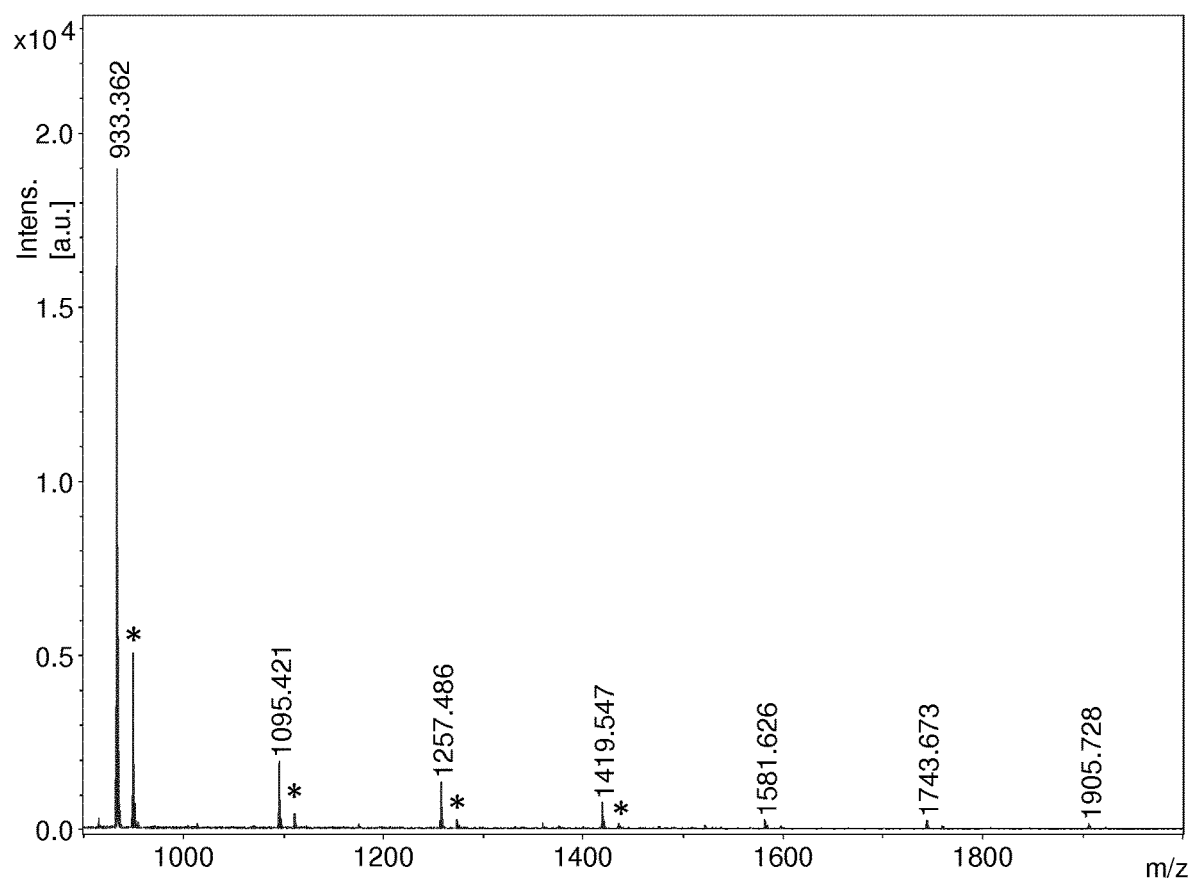
FIG. 7. MALDI-TOF MS image of neutral N-glycans released from antibody from strain M908 fermented in for 6 days. K$^+$ adducts marked with asterisk.

Fermentation and glycan analysis of strain M908. *T. reesei* strain M908 (pTTv348 transformant 80-1) was fermented in 4% WSG, 2% glucose, 4% cellobiose and 6% lactose and samples were collected at days 3-6. The N-glycan analysis was performed as described above. The results are shown in Table 17. The main glycoform is Man3 (79.1%) and the expression of *A. niger* GLS II α- and β-subunits has reduced the Hex6 level to 3.3%. FIG. 7 shows MALDI-TOF image of the fermented M908 neutral N-glycans on antibody at day 6.

TABLE 17

Relative proportions (%) of the predominant neutral N-glycans from purified MAB01 antibody from strain M908 fermented in WSG medium.

|  | Hex6 | Man3 | GnMan3 | G0 |
|---|---|---|---|---|
| Day 5 | 4.6 | 74.0 | 0 | 0 |
| Day 6 | 3.3 | 79.1 | 0 | 0 |

Example 5

Generation of Strain Producing MAB01 and Expressing *A. niger* GLSIIα and β (M911)

This example describes the generation of *T. reesei* strain with the following characteristics:
it is deficient for alg3 and pep1, tsp1, slp1, gap1, gap2, pep4, pep3 genes,
it overexpresses the *A. niger* glucosidase 2 α subunit encoding gene (with HDEL) together with β-subunit encoding gene,
it comprises GnTI and GnTII genes.

The resulting strains M911 produces Rituximab with 0% G0 glycoform (GnTII did not work), 50.7% GlcNAcMan3 glycoform and only 1.6% of undesirable Hex6 glycoform.

Transformation into G0 *T. reesei* strain. To prepare the vector for transformation, the pTTv349 vector was cut with PmeI to release the expression cassette and the fragment prepared as described above for pTTv348. The *T. reesei* G0 M629 pyr4− strain (described in the Example 11 of WO2013/174927), was transformed with the pTTv349 expression fragment. The strain was generated as described for pTTv348, with the exception that the construct was targeted to the xyn1 locus and the PCR screening was therefore performed with oligos for screening integration to xyn1. The primers used are listed in Table 18.

TABLE 18

List of primers used for PCR screening of pTTv349 *T. reesei* Transformants.

| 5' flank screening primers: | 1278 bp product |
|---|---|
| T403_Xyn1_5screen_F | CCGCGTTGAACGGCTTCCCA (SEQ ID NO: 587) |
| T176_pcbh1_seq_r4 | CTCCGGGTTCGCAGCAGCTT (SEQ ID NO: 588) |
| 3' flank screening primers: | 1467 bp product |
| T026_Pyr4_orf_5rev2 | CCATGAGCTTGAACAGGTAA (SEQ ID NO: 589) |
| T404_Xyn1_3screen_R | GCGACGGCGACCCATTAGCA (SEQ ID NO: 590) |
| xyn1 ORF primers: | 589 bp product |
| T405_Xyn1_orf_screen_F | TGCGCTCTCACCAGCATCGC (SEQ ID NO: 591) |
| T406_Xyn1_orf_screen_R | GTCCTGGGCGAGTTCCGCAC (SEQ ID NO: 592) |

Figure 8:
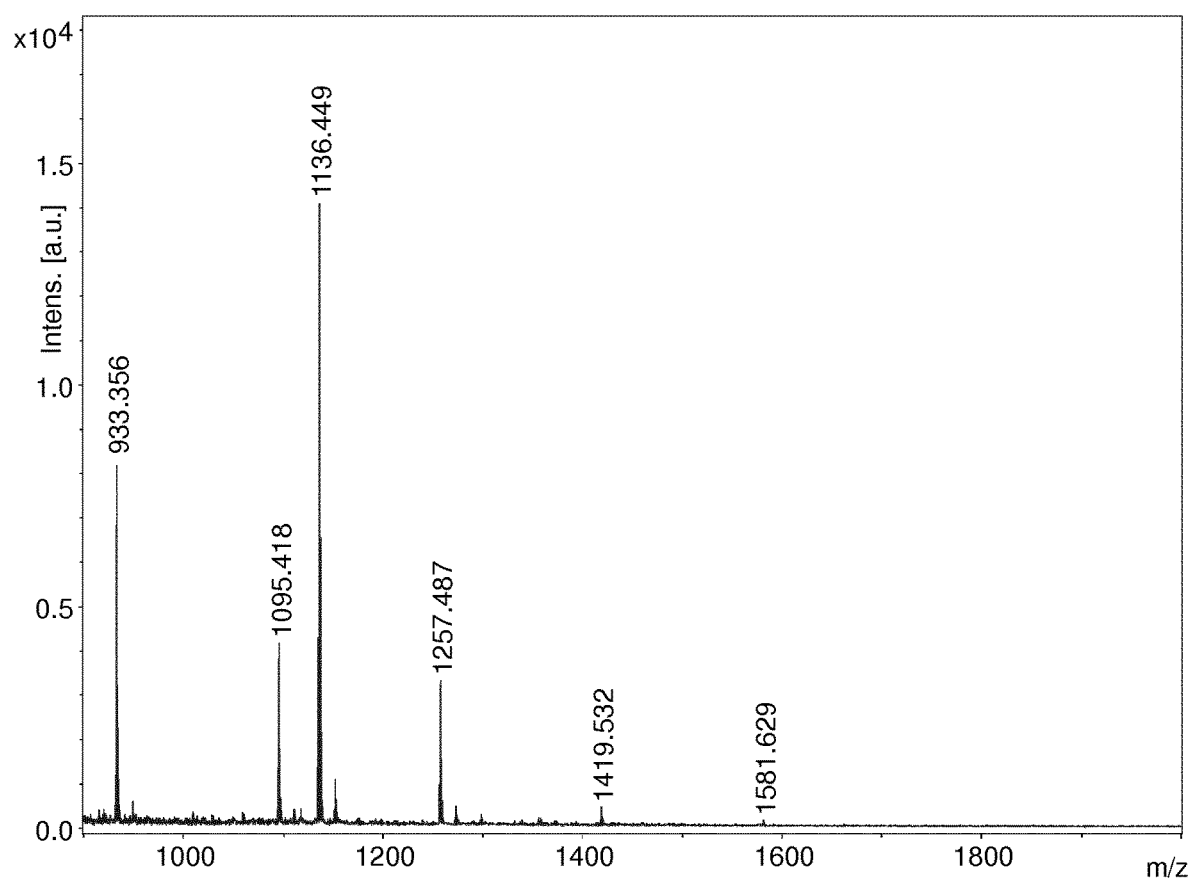
FIG. 8. MALDI-TOF MS image of neutral N-glycans released from antibody from strain M911 fermented in for 4 days.
Figure 9:
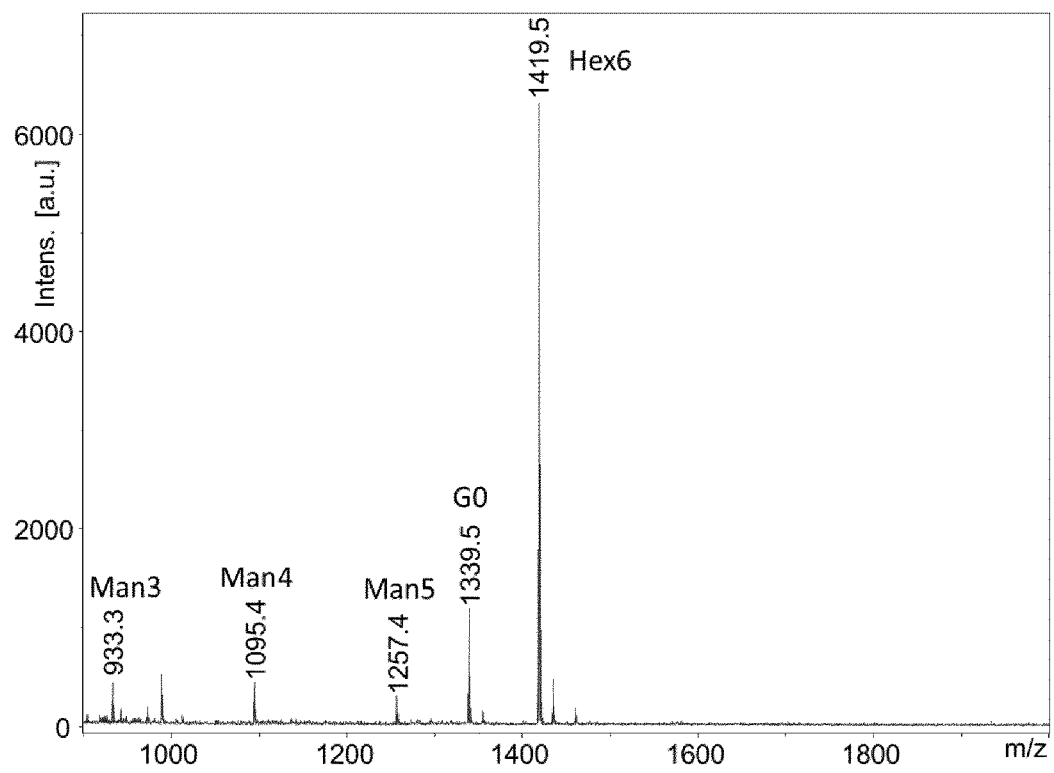
FIG. 9. MALDI-TOF MS image of neutral N-glycans released from antibody from strain M1146 fermented in for 5 days.
Figure 10:
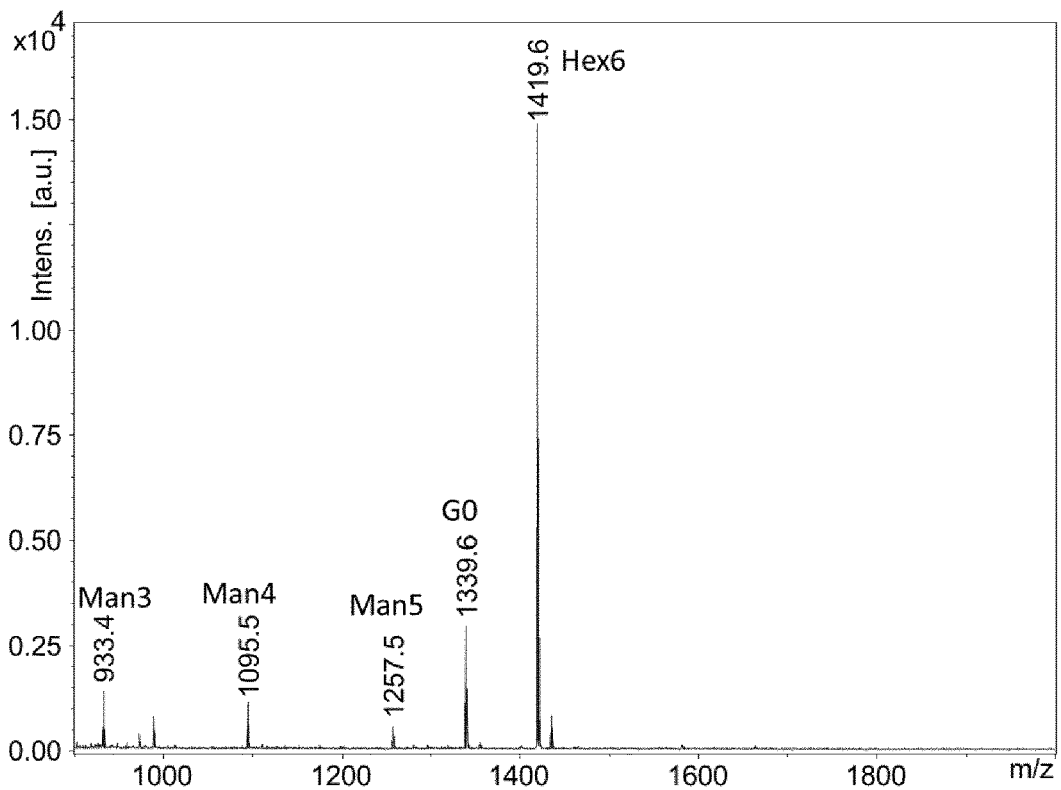
FIG. 10. MALDI-TOF MS image of neutral N-glycans released from antibody from strain M1147 fermented in for 5 days.
Figure 11:
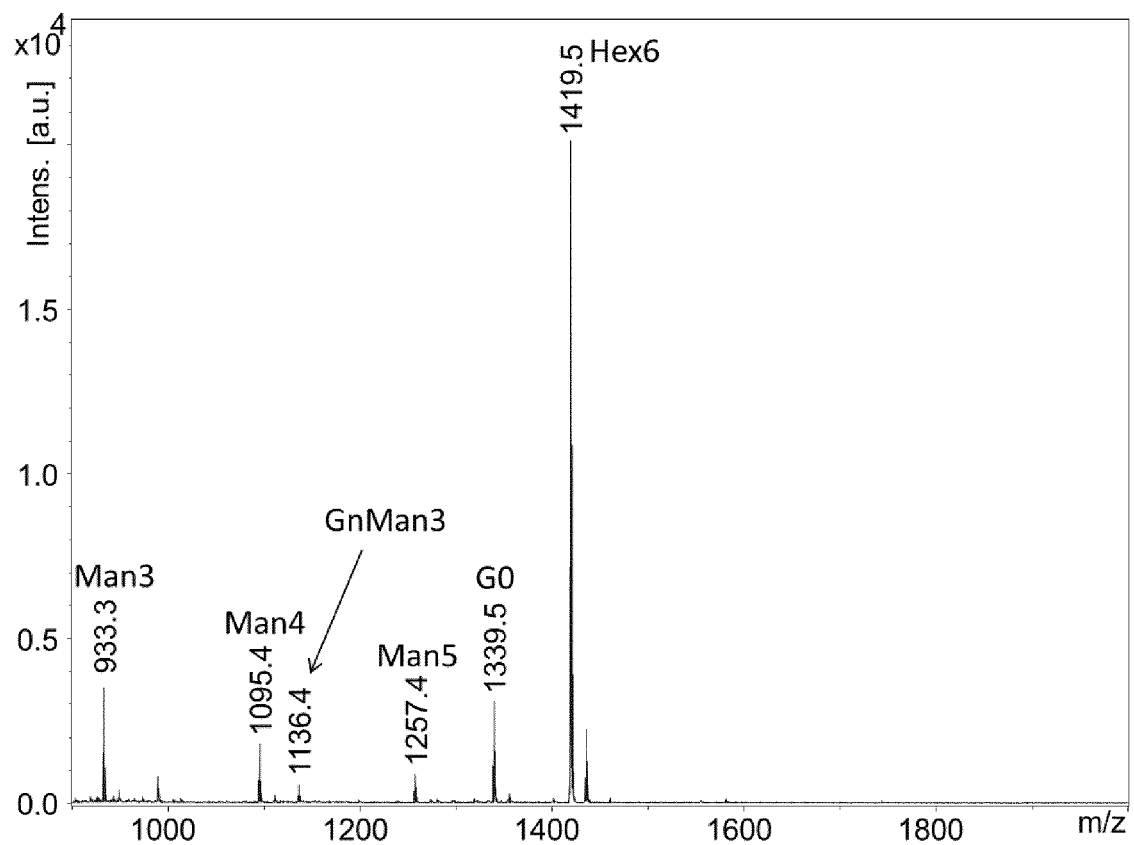
FIG. 11. MALDI-TOF MS image of neutral N-glycans released from antibody from strain M1148 fermented in for 5 days.
Figure 12:
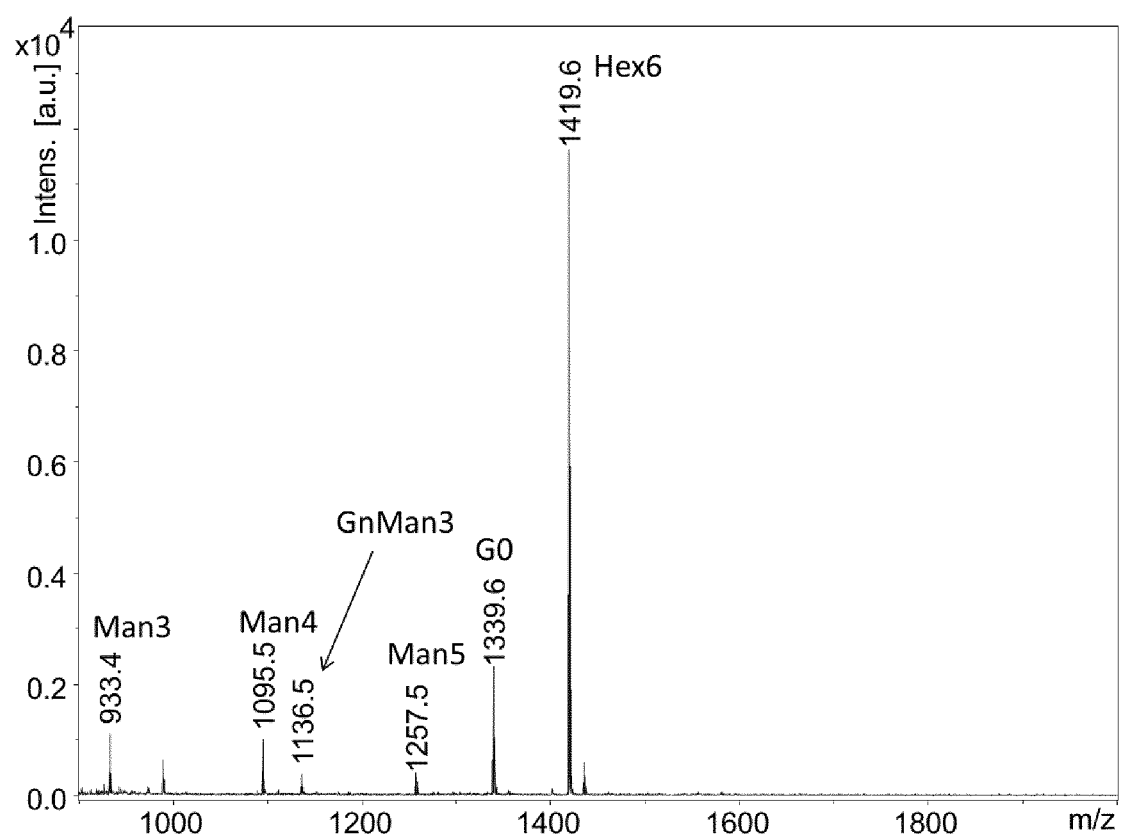
FIG. 12. MALDI-TOF MS image of neutral N-glycans released from antibody from strain M1149 fermented in for 5 days.

Fermentation and glycan analysis of strain M911. *T. reesei* strain M911 (pTTv349 transformant 15-18) was fermented in 4% WSG, 2% glucose, 4% cellobiose and 6% lactose and samples were collected at days 3-6. The N-glycan analysis was performed as described above and results are shown in Table 19. The expression of *A. niger* GLSIIα and β subunits has reduced the amount of Hex6 to 1.6% at day 4. FIG. 8 shows MALDI-TOF image of the fermented M911 neutral N-glycans on antibody at day 4.

TABLE 19

Relative proportions (%) of the predominant neutral N-glycans from purified MAB01 antibody from strain M911 fermented in WSG medium.

|  | Hex6 | Man3 | GnMan3 | G0 |
|---|---|---|---|---|
| Day 4 | 1.6 | 26.6 | 45.8 | 0 |
| Day 5 | 2.7 | 20.8 | 50.7 | 0 |

Example 6

Generation of Strain Producing GnMan3 MAB01 (M662)

This example describes the generation of *T. reesei* strain with the following characteristics:

it is deficient for alg3 and pep1, tsp1, slp1, gap1, gap2, pep4, pep3 protease genes, it comprises GnTI recombinant gene, The resulting strains M662 produces MAB01 with only 12% GlcNAcMan3 glycoform and 28% of undesirable Hex6 glycoform.

Strain M662 was made by transforming the M507 with vector pTTg175 (pCDNA-(Kre2)huGnTI-tCBHI>alg3). pTTg175 was constructed from pTTv141 having alg3 5' and 3' flanks by cutting with NotI/SgfI, resulting to a linearized backbone vector with both flanking sequences. Fragment 1 containing short overlap to 5'flank, cDNA promoter, Kre2 targeting signal and short overlap to truncated coding region of human GnTI was amplified from pTTv225 template with primers GP333 and GP339 (Table 20). Fragment 2 containing truncated coding region of human GnTI, tCBHI and short overlap to alg3 3' flank was PCR amplified from pTTv11 template with primers GP340 and GP336 (Table 20). Fragments 1 and 2 were combined to the backbone by yeast recombination, using the standard procedure. Yeast recombination resulted to intermediate vector pTTg148. Hygromycin—Pyr double marker cassette was inserted to pTTg148 by standard restriction cloning with NotI, resulting to vector pTTg175. *Trichoderma* transformation, strain screening and purification were performed as described above.

TABLE 20

GP333  5'CAGATTTCAGTCTCTCACCACTCACCTGAGTTGCCTCT
       CTCGCGACTAGTGGTCTGAAGGACGTGGAATG3'
       (SEQ ID NO: 593)

GP339  5'CGGTGGGCACCCTCCCCCGCTGGCTCGACAGGGCAT
       CCCCGTTCATTCGAGGGCCGGG3' (SEQ ID NO: 594)

GP340  5'GGGGATGCCCTGTCGAGCCAGCGGGGAGGGTGCCC
       ACCGCCGCCCCTCCCGCCCAGCCG3' (SEQ ID NO: 595)

GP336  5'GAAGGTGGTTTTTGCCTGTATAAGCCAGCCATCCGGCA
       TACTGCCCGCGGCCGCCCTGCAGTGCAGGATCTGC3'
       (SEQ ID NO: 596)

Transformation into G0 *T. reesei* strain. *T. reesei* strain M662 was fermented in 4% WSG, 2% glucose, 4% cellobiose and 6% lactose and samples were collected at days 3-6. The N-glycan analysis was performed as described above. Results are shown in Table 21.

TABLE 21

Relative proportions (%) of the predominant neutral N-glycans from purified MAB01 antibody from strain M662 fermented in WSG medium.

|  | Hex6 | Man3 | GnMan3 | G0 |
|---|---|---|---|---|
| Day 3 | 17 | 0 | 11 | 0 |
| Day 5 | 28 | 3 | 12 | 0 |

Example 7

Generation of MAB01 G0 Producing Strain with alg3 Deletion and GnTI and GnTII Expression (M1146-M1149)

This example describes the generation of *T. reesei* strain with the following characteristics:

it is deficient for alg3 and pep1, tsp1, slp1, gap1, gap2, pep4, pep3 protease genes, it comprises GnTI and GnTII genes, The resulting strains M1146-M1149 produces MAB01 with only 14% G0 glycoform and 70.9% of undesirable Hex6 glycoform.

TABLE 22

Generation of M1146-M1149 from M507 (proteases deleted pep1 tsp1 slp1 gap1 gap2 pep4 pep3).

| Strain | Vector | Strain Clone | trans-formed | Locus | Description |
|---|---|---|---|---|---|
| M608 | pTTv274 | 103A | M507 | egl2 | MAB01 tandem expression; GNT2 golgi targeting signal-GNT1 |
| M769 | 5-FOA of M608 | 1A | pyr4- of M608 | pyr4 loopout | pyr4 negative strain of M608 |
| M872 | pTTn088 | 28 | M769 | EndoT | Lm STT3; MAB01 tandem expression; GNT2 golgi targeting signal-GNT1 |
| M1100 | 5FOA of M872 | 1 | pyr4- of M872 | pyr4 loopout | removal of pyr4 marker |
| M1146 | pTTv140 | 20-3 | M1100 | alg3 | cbh1p-Human GNT2, codon harmonized with alg3 flanks and pyr4 loop marker |
| M1147 | pTTv140 | 20-4 | M1100 | alg3 | cbh1p-Human GNT2, codon harmonized with alg3 flanks and pyr4 loop marker |
| M1148 | pTTv141 | 47-3 | M1100 | alg3 | gpdAp-Human GNT2, codon harmonized with alg3 flanks and pyr4 loop marker |
| M1149 | pTTv141 | 75-1 | M1100 | alg3 | gpdAp-Human GNT2, codon harmonized with alg3 flanks and pyr4 loop marker |

Construction of pTTv274. In the vector pTTv077, which consists of the pRS426 backbone, egl2 5' and 3' integration flanks, the cbh1 promoter and cbh1 terminator and the pyr4 selection marker, the cbh1 promoter was exchanged to gpdA promoter by restriction enzyme digest of vector pTTv086, with FseI-PacI promoter fragment ligated into pTTv077, creating the vector pTTv256 (Table 23). As a next step the pyr4 marker was exchanged with a hygromycin marker derived from pRLMex30, consisting of a pki promoter the hygromycin coding sequence and the cbh2 terminator, where an innate NotI site in the promoter was removed before by digest with NotI followed by polishing the cutting sites with Mungbean Nuclease and subsequent religation. The exchange of the marker cassette was done by yeast recombination cloning, first amplifying the hygromycin cassette using pRLMex30 as template and recombine with pTTv256 eluted from NotI digest. These modifications produced the vector pTTv264. To add human GnT1 and create the vector pTTv265, pTTv264 was linearized with PacI and yeast recombination cloning was used to integrate a purified GnT1 PCR fragment amplified from pTTv11. In the final step to pTTv274 a GnT2 signal sequence for Golgi targeting was added in between gpdA promoter and GnT1 using again PacI site and yeast recombination cloning.

TABLE 23

List of primers used for cloning vectors
pTTv256, pTTv265 and pTTv274

| Primer | Sequence |
|---|---|
| T974-Cbh1t + NotI + PKI promoter 5'end | GACCAACTTGTCCGTTGCGAGGCCAACTTGCATTGCTGTCAAGACGAT GAGCGGCCGCATAACGGTGAGACTAGCGGC (SEQ ID NO: 597) |
| T942_pTTv256_3'end + NotI + tcbh2_rev | ATACAAACGTTGGCGAGGCTTCTGCATTCAGCTCAGAGTGGCGGCCGC GTGCTGCGGAATCATTATCATCTG (SEQ ID NO: 598) |
| T943_GPDAp + TC + PacI + GNT1_F | GCAGCTTGACTAACAGCTACCCCGCTTGAGCAGACATCATCTTAATTAA TCAGTCAGCGCTCTCGATGGC (SEQ ID NO: 599) |
| T944_Cbh1t(pTTv256) + SwaI + GNT1_R | CCAATACCGCCGCACTGGCCGTAGTGAGACTGGGTAGGTCATTTAAAT CTAATTCCAGCTGGGATCATAG (SEQ ID NO: 600) |
| T945_GNT2-gts-f | GCAGCTTGACTAACAGCTACCCCGCTTGAGCAGACATCATCATGCGCT TCCGAATCTACAAG (SEQ ID NO: 601) |
| T946_GNT2-gts-r | GGGTGAGGCTGGCGGGGTCGCCATCGAGAGCGCTGACTGAGGGGTG ATCCCCTCCCCTG (SEQ ID NO: 602) |

The human GnT1 protein sequence (with 5' deletion) is shown in SEQ ID NO:480 and its codong optimized sequence in SEQ ID NO:481.

The human GnT2 targeting signal protein sequence is shown in SEQ ID NO:482 and its coding sequence in SEQ ID NO: 483.

Generation of M608. Plasmids pTTv274 was digested with PmeI to release the fragment for targeted integration and separated with agarose gel electrophoresis. Correct fragments were isolated from gel with gel extraction kit (Quiagen) essentially according to the manufacturer's protocol. Approximately 5 µg purified fragment was used to transform protoplasts of MAB01 producing strain M507 (from PCT/EP2013/050126).

Transformants were streaked onto selective plates. Growing clones were screened for correct integration by PCR using primers listed in Table 24. Clones giving expected signals were purified to single cell clones and rescreened for correct integration and clone purity by PCR using primers listed in Table 24. After shake flask cultivation, two clones were selected and designated with numbers M608 (clone #103A) and M609 (clone #129A).

Generation of M769. Marker removal (pyr4) from M608 was carried out essentially as described in PCT/EP2013/050126. Consecutive 5-FOA selection steps were carried out to ensure that the clones originated from single cells. Final clones were verified by plating the clones onto minimal medium plates with or without 5 mM uridine. Resulting pyr4– strain was designated with strain number M769 (clone 1A).

Generation of M872. A plasmid targeted to delete EndoT by simultaneous introduction of Lm-STT3 was digested with PmeI to release the fragment for targeted integration and separated with agarose gel electrophoresis. Approximately 5 µg purified fragment was used to transform protoplasts of MAB01 producing strain M769. Transformants were streaked onto selective plates. Growing clones were screened for correct integration by PCR using primers listed in Table 25. Clones giving expected signals were purified to single cell clones and rescreened for correct integration and clone purity by PCR using primers listed in Table 25. After shake flask cultivation, several clones (24,27,28,30) were selected and designated with numbers M870-M873. (clone #28->M872).

TABLE 24

List of primers used for PCR screening of pTTv247 T. reesei transformants

| 5' Integration | T1155_egl2 5pr intF1 | CAACCAGACTGTCCCTTCTAC (SEQ ID NO: 603) |
|---|---|---|
| | T045_gpdA_prom_start_R | CTTCAAGTCAGCCAACTGCAA (SEQ ID NO: 604) |
| 3' Integration | T161_tcbh2_seq_f2 | CAGCTGCGGAGCATGAGCCT (SEQ ID NO: 605) |
| | T1157_egl2 3pr intR1 | CTTTTTTCCCAAGATGATAG (SEQ ID NO: 606) |
| Locus | egl2.5probe | CCAACCACCACCACCAGGGC (SEQ ID NO: 607) |
| | egl2.3probe | GGTTGAGATATTGGATTTGC (SEQ ID NO: 608) |

TABLE 25

List of primers used for PCR screening of pTTn088 T. reesei transformants

| 5' Integration | T1427_EndoT-int-F | CGAAACCGCAACGGAGCTAC (SEQ ID NO: 609) |
|---|---|---|
| | T140_cDNA1promoter_seqR1 | TAACTTGTACGCTCTCAGTTCGAG (SEQ ID NO: 610) |

TABLE 25-continued

List of primers used for PCR screening of pTTn088 T. reesei transformants

| | | |
|---|---|---|
| 3' Integration | T061_pyr4_orf_screen_2F | TTAGGCGACCTCTTTTTCCA (SEQ ID NO: 611) |
| | T1428_EndoT-int-R | GAGAATTACACCGAGCTGAG (SEQ ID NO: 612) |
| Locus | T1476_endoT_new_del_F | TCTACACGCTGTGGAACGAG (SEQ ID NO: 613) |
| | T1477_endoT_new_del_R | CGTCCTCCGTAATCTTCAGC (SEQ ID NO: 614) |

Generation of M1100. Marker removal (pyr4) from M872 was carried out essentially as described in PCT/EP2013/050126. Consecutive 5-FOA selection steps were carried out to ensure that the clones originated from single cells. Final clones were verified by plating the clones onto minimal medium plates with or without 5 mM uridine. Resulting pyr4− strain was designated with strain number M1100 (clone 1).

isolated from the gel with a gel extraction kit (Qiagen) according to manufacturer's protocol. The plasmid DNA was rescued from yeast and transformed into electro competent E. coli and plated on LB agar plates with ampicillin (100 μg/ml). Colony PCR were made from several colonies. Positive colonies were grown in LB with ampicillin for plasmid preparation and purified plasmids were sequenced. One correct clone each was chosen to be the final vectors pTTv141 (cbh1 promoter) and pTTv142 (gpdA promoter).

TABLE 26

List of primers used for cloning vectors pTTv140 and pTTv141

| Primer | Sequence |
|---|---|
| T667_Tdm2-1_alg3_5-prime_F | AGATTTCAGTCTCTCACCACTCACCTGAGTTGCCTCTCTCGCGATCGCT CTAGAGTCGACCATTCTCACGGTGAATGTAGGCCTTTTG (SEQ ID NO: 615) |
| T668_Tdm2-1_alg3_5-prime_R | CAAAAGGCCTACATTCACCGTGAGAATGGTCGACTCTAGAGCGATCGC GAGAGAGGCAACTCAGGTGAGTGGTGAGAGACTGAAATCT (SEQ ID NO: 616) |
| T669_Tdm2-1_pyr4_5-prime_F | AGGACCTTAATTAATCATATATGCAGATCCTGCACTGCAGGCGATCGCG CGGCCGCCTAGCATCGACT (SEQ ID NO: 617) |
| T670_Pyr4_loop_alg3_3-prime_R | GGTTTTTGCCTGTATAAGCCAGCCATCCGGCATACTGCCCGCGGCCGC GGCTGATGAGGC (SEQ ID NO: 618) |
| T678_TrpC_term_pyr4_5-prime_F | AAGCGCCCACTCCACATCTCCACTCGACCTGCAGGCATGCGCGATCGC GCGGCCGCCTAGCATCGACT (SEQ ID NO: 619) |
| T679_Alg3_5-prime_gpdA_prom_F | AGATTTCAGTCTCTCACCACTCACCTGAGTTGCCTCTCTCGCGATCGCC CTTGTATCTCTACACACAGGCTCAAATCAATAAGAAGAA (SEQ ID NO: 620) |
| T680_Alg3_5-prime_gpdA_prom_R | TTCTTCTTATTGATTTGAGCCTGTGTGTAGAGATACAAGGGCGATCGCG AGAGAGGCAACTCAGGTGAGTGGTGAGAGACTGAAATCT (SEQ ID NO: 621) |

Construction of pTTv140 and pTTv141. The human GnT2 coding sequence was codon optimized for T. reesei expression. The optimized coding sequence was cloned into two T. reesei expression vector between the cbh1 promoter and terminator and gpdA promoter and TrpC terminator, creating plasmids pTTv15 and pTTv17, respectively. For integration into alg3 locus the alg3 deletion plasmid pTTv38 was digested with NotI to release the marker and the resulting plasmid backbone was used for cloning with yeast homologous recombination. The human Gnt2, with promoters and terminators, were obtained by PCR using the pTTv15 and pTTv17 as template. A pyr4 loopout marker was also generated by PCR, using the plasmid pTTv71 as template. The primers used are listed in Table 26. The digested fragment and PCR products were separated with agarose gel electrophoresis and the correct fragments were Generation of M1146 and M1147. Plasmids pTTv140 (cbh1-promoter; GnT2; alg3 locus) was digested with PmeI to release the fragment for targeted integration and separated with agarose gel electrophoresis and approximately 5 μg purified fragment was used to transform protoplasts of MAB01 producing strain M1100. Preparation of protoplasts and transformation were carried out essentially as described above.

Transformants were streaked onto selective plates. Growing clones were screened for correct integration by PCR using primers listed in Table 27. Clones giving expected signals were purified to single cell clones and rescreened for correct integration and clone purity by PCR using primers listed in Table 27. After glycan analysis, clones (20-3,20-4) were selected and designated with numbers M1146 and M1147, respectively.

TABLE 27

List of primers used for PCR screening of pTTv140 T. reesei transformants

| | | | |
|---|---|---|---|
| 5' Integration | T067_104121_5int2 | AACTCGGTGGTGTCAAGGAC | (SEQ ID NO: 622) |
| | T037_Cbh1_prom_start_R | TGCCATGACTCACTGATTGG | (SEQ ID NO: 623) |
| 3' Integration | T061_pyr4_orf_screen_2F | TTAGGCGACCTCTTTTTCCA | (SEQ ID NO: 624) |
| | T068_104121_3int | GATTGTCATGGTGTACGTGA | (SEQ ID NO: 625) |
| Locus | T069_104121_5orf_pcr | GCGTCACTCATCAAAACTGC | (SEQ ID NO: 626) |
| | T070_104121_3orf_pcr | CTTCGGCTTCGATGTTTCA | (SEQ ID NO: 627) |

Generation of M1148/M1149. Plasmids pTTv141 (gpdA-promoter; GnT2; alg3 locus) was digested with PmeI to release the fragment for targeted integration and separated with agarose gel electrophoresis and approximately 5 µg purified fragment was used to transform protoplasts of MAB01 producing strain M1100 as described above.

Transformants were streaked onto selective plates. Growing clones were screened for correct integration by PCR using primers listed in Table 28. Clones giving expected signals were purified to single cell clones and rescreened for correct integration and clone purity by PCR using primers listed in Table 28. After glycan analysis, clones (47-3,75-1) were selected and designated with numbers M1148 and M1149, respectively.

TABLE 28

List of primers used for PCR screening of pTTv141 T. reesei transformants

| | | | |
|---|---|---|---|
| 5' Integration | T067_104121_5int2 | AACTCGGTGGTGTCAAGGAC | (SEQ ID NO: 628) |
| | T045_gpdA_prom_start_R | CTTCAAGTCAGCCAACTGCAA | (SEQ ID NO: 629) |
| 3' Integration | T061_pyr4_orf_screen_2F | TTAGGCGACCTCTTTTTCCA | (SEQ ID NO: 630) |
| | T068_104121_3int | GATTGTCATGGTGTACGTGA | (SEQ ID NO: 631) |
| Locus | T069_104121_5orf_pcr | GCGTCACTCATCAAAACTGC | (SEQ ID NO: 632) |
| | T070_104121_3orf_pcr | CTTCGGCTTCGATGTTTCA | (SEQ ID NO: 633) |

The human GnT2 protein sequence is shown in SEQ ID NO:142. The human GnT2 DNA (codon harmonized for T. reesei) sequence is shown in SEQ ID NO:484.

Fermentation of strains M1146-M1149. T. reesei strains M1146-M1149 were fermented in 4% WSG, 2% glucose, 4% cellobiose and 6% lactose and samples were collected at days 3-6. The N-glycan analysis was performed as described above. Results are shown in Table 29. FIGS. 9, 10, 11 and 12 show MALDI-TOF images of the fermented M1146, M1147, M1148 and M1149, respectively, neutral N-glycans on antibody at day 5.

TABLE 29

Relative proportions (%) of the predominant neutral N-glycans from purified antibody from strains M1146, M1147, M1148 and M1149 fermented in WSG medium, day 5.

| | Man3 | Man4 | GnMan3 | Man5 | G0 | Hex6 |
|---|---|---|---|---|---|---|
| M1146 | 5.0 | 5.0 | 0.0 | 3.4 | 13.5 | 70.9 |
| M1147 | 6.7 | 5.5 | 0.0 | 2.6 | 14.0 | 70.6 |
| M1148 | 11.6 | 6.0 | 1.9 | 2.9 | 10.2 | 66.1 |
| M1149 | 6.6 | 6.0 | 2.4 | 2.6 | 13.8 | 68.7 |

Example 8

Generation of MAB01 Producing Strain with Och1 Deletion (M890 and M891)

This example describes the generation of T. reesei strain with the following characteristics:
it is deficient for pep1, tsp1, slp1, gap1, gap2, pep4, pep3 protease genes and Och1 gene.

The resulting strains M890/M891 produce MAB01 with 34.7% Man5 glycoform.

Cloning of pTTv344. Plasmids directed to the och1 locus and overexpressing T. reesei α 1,2-mannosidase 1 (Manl; tre45717) in native and ER-retained forms were first cloned. The plasmids were cloned using yeast homologous recombination and, as vector backbone, the yeast vector pRS426, EcoRI-XhoI digested, was used (Colot et al., PNAS 2006, 103(27):10352-7). The plasmids were directed to the och1 locus (tre65646) and the och1 integration flanks were created by PCR from genomic DNA from the strain M124. The α 1,2-mannosidase 1 was also created by PCR from genomic M124 DNA. The cDNA1 promoter and TrpC terminator fragments were generated from plasmids containing the sequences, pTTv182 and pTTv144, respectively. An ER-retention signal was added to the C-terminus of the α 1,2-mannosidase 1 for the ER-retained form. The primers used are listed in Table 30. A pyr4 loopout marker was digested with NotI from the plasmid pTTv324. The PCR products and DNA fragment were separated with agarose gel electrophoresis and the correct fragments were isolated from the gel with a gel extraction kit (Qiagen) according to manufacturer's protocol. The plasmid was constructed using the yeast homologous recombination method. The plasmid DNA was rescued from yeast and transformed into electro competent E. coli that were plated on ampicillin (100 µg/ml) selection plates. Miniprep plasmid preparations were made from four colonies each. The plasmids were control digested with PmeI and AsiSI and promising plasmids were sequenced to verify the sequence. One correct clone in native form was chosen to be plasmid pTTv342 and one correct ER-retained form to be plasmid pTTv343.

Plasmid pTTv343 was digested with AsiSI to release the α 1,2-mannosidase 1 overexpression fragment, and the vector backbone with the och1 flanks and pyr4 marker was ligated with T4 ligase. The plasmid was transformed to electro competent *E. coli* that were plated on ampicillin (100 µg/ml) selection plates. Miniprep plasmid preparations were made from several colonies. The plasmids were control digested with MssI and AsiSI, and one clone chosen to be plasmid pTTv344.

TABLE 30

List of primers used for cloning vectors pTTv342 and pTTv343

| Fragment | Primer | Primer sequence |
| --- | --- | --- |
| och1 5'flank | T1270_pRS426_och1_5fl_fw | GATTAAGTTGGGTAACGCCAGGGTTTTCCCAGTCACGACGG TTTAAACTCAAAGTGGGTTCGGTGATG (SEQ ID NO: 634) |
| | T1271_och1_5fl_cDNA1p_rev | GTCATTAAGTCCATCATTCCACGTCCTTCAGACCGAATTCGC GATCGCGCTGGGCTCCTTGTCTGCCT (SEQ ID NO: 635) |
| cDNA1 promoter | T495_cDNA1_for | GAATTCGGTCTGAAGGACGT (SEQ ID NO: 636) |
| | T138_cDNA1_Rev | GTTGAGAGAAGTTGTTGGATTG (SEQ ID NO: 637) |
| α 1,2-mannosidase 1 | T1272_cDNA1_1,2mannosidase_fw | AACCAAAGACTTTTTGATCAATCCAACAACTTCTCTCAACATG AGATTCCCTAGCAGCTC (SEQ ID NO: 638) |
| | T1273_1,2mannosidase_trpct_rev | CGTCAAGCTGTTTGATGATTTCAGTAACGTTAAGTGGATCTT AAGCAAGGTGGCCGCCCC (SEQ ID NO: 639) |
| α 1,2-mannosidase 1 with ER signal | T1272_cDNA1_1,2mannosidase_fw | AACCAAAGACTTTTTGATCAATCCAACAACTTCTCTCAACATG AGATTCCCTAGCAGCTC (SEQ ID NO: 640) |
| | T1276_1,2mannosidaseHDEL_rev | CGTCAAGCTGTTTGATGATTTCAGTAACGTTAAGTGGATCTT AGAGCTCGTCGTGAGCAAGGTGGCCGCCCCGTC (SEQ ID NO: 641) |
| TrpC terminator | T087_trpC_f | GATCCACTTAACGTTACTGAAATCAT (SEQ ID NO: 642) |
| | T1267_trpCt_mcs_pyr4_rev | GCGCTGGCAACGAGAGCAGAGCAGCAGTAGTCGATGCTAG GCGGCCGCGCGATCGCGGCCGGCCGAGTGGAGATGTGGA GTGGG (SEQ ID NO: 643) |
| och1 3'flank | T1274_pyr4_och1_3fl_fw | CAACCAGCCGCAGCCTCAGCCTCTCTCAGCCTCATCAGCCG CGGCCGCCCGAATTGTCTCAAGGCACA (SEQ ID NO: 644) |
| | T1275_pRS426_och1_3fl_rev | TGGAATTGTGAGCGGATAACAATTTCACACAGGAAACAGCG TTTAAACCACCACGGACTGCACTCAAT (SEQ ID NO: 645) |

Strain generation. To prepare the vectors for transformation, the vectors were cut with MssI to release the deletion construct. The fragments were separated with agarose gel electrophoresis and the correct fragment was isolated from the gel with a gel extraction kit (Qiagen) according to manufacturer's protocol. The purified expression cassette DNA (~5 µg) was then transformed into protoplasts of the *Trichoderma reesei* M564 MAB01 expressing pyr4– strain. Preparation of protoplasts and transformation were carried out essentially as described in WO2013/102674 using pyr4 selection.

Transformants were streaked onto selective plates. Growing clones were screened for correct integration by PCR using primers listed in Table 31. Clones giving expected signals were purified to single cell clones and rescreened for correct integration and clone purity.

TABLE 31

List of primers used for PCR screening of *T. reesei* pTTv344 transformants.

| 5' integration screening primers: | 1347 bp product |
| --- | --- |
| T1387_och1_5fl_fw_scrn | GCCGTGCTGGGGAGGTGGTA |
| T140_cDNA1promoter_seqR1 | TAACTTGTACGCTCTCAGTTCGAG (SEQ ID NO: 646) |
| 3' integration screening primers: | 1786 bp product |
| T028_Pyr4_flank_rev | CATCCTCAAGGCCTCAGAC (SEQ ID NO: 647) |
| T1388_och1_3fl_rev_scrn | CCACGCCAGCCTTTCCGTCT (SEQ ID NO: 648) |
| och1 ORF primers: | 513 bp product |
| T1389_och1_orf_fw | TGGAGGAAGACGCCGAGCGA (SEQ ID NO: 649) |
| T1390_och1_orf_rev | GACCACGCGGTTGCCCTGAA (SEQ ID NO: 650) |

Four clones for pTTv344 were grown in large shake flasks in TrMM medium supplemented with 40 g/l lactose, 20 g/l spent grain extract, 9 g/l casamino acids and 100 mM PIPPS, pH 5.5. Two clones were designated the numbers M890 (#74-1) and M891 (#78-2).

Glycan analysis of shake flask samples. The N-glycan analysis of antibody was performed to day 5 shake flask samples of all four pTTv344 clones as described above. Results are shown in Table 32.

TABLE 32

Relative proportions of the neutral N-glycans from purified MAB01 antibody from pTTv344 clones (Δoch1) cultured in shake flasks for 5 days.

| Composition | Short | m\z | #74/1 % | #74/3 % | #78/2 % | #78/4 % |
|---|---|---|---|---|---|---|
| Hex5HexNAc2 | Man5 | 1257.42 | 79.5 | 77.8 | 76.9 | 54.6 |
| Hex6HexNAc2 | Man6 | 1419.48 | 14.7 | 13.4 | 12.0 | 15.6 |
| Hex7HexNAc2 | Man7 | 1581.53 | 4.2 | 5.8 | 7.3 | 18.7 |
| Hex8HexNAc2 | Man8 | 1743.58 | 1.0 | 2.0 | 2.3 | 5.5 |
| Hex9HexNAc2 | Man9 | 1905.63 | 0.6 | 0.9 | 1.5 | 5.5 |

Fermentation and glycan analysis of M891. *T. reesei* strain M891 was fermented in 2% YE, 4% cellulose, 4% cellobiose and 2% sorbose and samples were collected at days 3-5. The N-glycan analysis of antibody was performed as described above. Results are shown in Table 33.

TABLE 33

Relative proportions of the neutral N-glycans from purified MAB01 antibody from strain M891 fermented in YE medium.

| Composition | Short | m\z | d3 % | d4 % | d5 % |
|---|---|---|---|---|---|
| Hex5HexNAc2 | Man5 | 1257.4 | 34.0 | 32.2 | 34.7 |
| Hex6HexNAc2 | Man6 | 1419.5 | 22.5 | 18.6 | 20.8 |
| Hex7HexNAc2 | Man7 | 1581.5 | 33.0 | 23.5 | 23.2 |
| Hex8HexNAc2 | Man8 | 1743.6 | 0.0 | 17.7 | 12.6 |
| Hex9HexNAc2 | Man9 | 1905.6 | 10.5 | 6.6 | 6.4 |
| Hex10HexNAc2 | Man10 | 2067.7 | 0.0 | 1.3 | 2.2 |

Example 9

Generation of MAB01 Producing Strain with Och1 Deletion and ManI Overexpression (M886/M887 and M888/M889)

This example describes the generation of *T. reesei* strain with the following characteristics:
- it is deficient for pep1, tsp1, slp1, gap1, gap2, pep4, pep3 protease genes and Och1 genes,
- it overexpresses *T. reesei* α1,2 mannosidase (with HDEL as targeting signal)

The resulting strains M886/M887 and M888/M889 produce MAB01 with almost only Man5 glycoform (98.1%).

Strain generation. To prepare the vectors for transformation, the vectors pTTv342 and pTTv343 were cut with MssI to release the deletion construct. The purified expression cassette DNA (~5 μg) was then transformed into protoplasts of the *Trichoderma reesei* M564 MAB01 expressing pyr4– strain as described above.

Transformants were streaked onto selective plates. Growing clones were screened for correct integration by PCR using primers listed in Table 31. Clones giving expected signals were purified to single cell clones and rescreened for correct integration and clone purity.

Four clones for pTTv342 and three clones of pTTv343 were grown in large shake flasks in TrMM medium supplemented with 40 g/l lactose, 20 g/l spent grain extract, 9 g/l casamino acids and 100 mM PIPPS, pH 5.5. Two clones of pTTv342 were designated the numbers M886 (#3-1) and M887 (#23-1) and two pTTv343 clones numbers M888 (#42-3) and M889 (#57-4).

Glycan analysis of shake flask samples. The N-glycan analysis of antibody was performed as described above to four pTTv342 clones and three pTTv343 clones cultivated in shake flasks for 5 days. Results are shown in Table 34 and Table 35.

TABLE 34

Relative proportions of the neutral N-glycans from purified MAB01 antibody from pTTv342 clones (*T. reesei* α1,2-mannosidase o/e, Δoch1) cultured in shake flasks for 5 days.

| Composition | Short | m\z | #3/1 % | #23/1 % | #30/5 % | #61/5 % |
|---|---|---|---|---|---|---|
| Hex5HexNAc2 | Man5 | 1257.42 | 96.5 | 91.6 | 96.6 | 89.6 |
| Hex6HexNAc2 | Man6 | 1419.48 | 1.2 | 2.2 | 1.4 | 2.8 |
| Hex7HexNAc2 | Man7 | 1581.53 | 1.2 | 2.3 | 1.0 | 3.0 |
| Hex8HexNAc2 | Man8 | 1743.58 | 1.1 | 1.8 | 1.0 | 2.2 |
| Hex9HexNAc2 | Man9 | 1905.63 | 0.0 | 2.1 | 0.0 | 2.5 |

TABLE 35

Relative proportions of the neutral N-glycans from purified MAB01 antibody from pTTv343 clones (*T. reesei* α1,2-mannosidase + HDEL o/e, Δoch1) cultured in shake flasks for 5 days.

| Composition | Short | m\z | #42/3 % | #57/4 % | #98/5 % |
|---|---|---|---|---|---|
| Hex5HexNAc2 | Man5 | 1257.42 | 89.4 | 77.8 | 70.2 |
| Hex6HexNAc2 | Man6 | 1419.48 | 5.3 | 11.3 | 11.3 |
| Hex7HexNAc2 | Man7 | 1581.53 | 2.8 | 5.5 | 5.7 |
| Hex8HexNAc2 | Man8 | 1743.58 | 2.5 | 5.5 | 4.9 |
| Hex9HexNAc2 | Man9 | 1905.63 | 0.0 | 0.0 | 7.9 |

Fermentation and glycan analysis of M887 and M889. *T. reesei* strains M507, M887 and M889 were fermented in 2% YE, 4% cellulose, 4% cellobiose and 2% sorbose, strain M887 also in 2% YE, 12% cellulose with 50% glucose/12.5% sorbose feed. Samples were collected at days 3-5. The N-glycan analysis of antibody was performed as described above. Results are shown in Table 36 and Table 37, and in Table 38.

It is remarkable that the high mannose structures have greatly decreased in strains with overexpression of mannosidase I as compared to M507 which did not overexpress mannosidase I.

TABLE 36

Relative proportions of the neutral N-glycans from purified MAB01 antibody from strain M887 fermented in YE medium ± feed.

| Composition | Short | m\z | Ye medium d3 % | Ye medium d4 % | Ye medium d5 % | YE medium + Glc/sorbose feed d3 % | YE medium + Glc/sorbose feed d4 % | YE medium + Glc/sorbose feed d5 % |
|---|---|---|---|---|---|---|---|---|
| Hex4HexNAc2 | Man4 | 1095.4 | 0.0 | 0.0 | 0.0 | 0.0 | 0.0 | 0.5 |
| Hex5HexNAc2 | Man5 | 1257.4 | 64.9 | 75.0 | 75.2 | 98.1 | 97.6 | 96.0 |
| Hex6HexNAc2 | Man6 | 1419.5 | 12.5 | 5.0 | 0.0 | 0.0 | 0.0 | 0.5 |
| Hex7HexNAc2 | Man7 | 1581.5 | 8.1 | 6.2 | 7.6 | 1.0 | 1.3 | 1.2 |
| Hex8HexNAc2 | Man8 | 1743.6 | 10.1 | 10.5 | 11.7 | 1.0 | 1.1 | 1.5 |
| Hex9HexNAc2 | Man9 | 1905.6 | 4.3 | 3.3 | 5.5 | 0.0 | 0.0 | 0.4 |
| Hex10HexNAc2 | Man10 | 2067.7 | 0.0 | 0.0 | 0.0 | 0.0 | 0.0 | 0.0 |

TABLE 37

Relative proportions of the neutral N-glycans from purified MAB01 antibody from strain M889 fermented in YE medium.

| Composition | Short | m\z | d3 % | d4 % | d5 % |
|---|---|---|---|---|---|
| Hex5HexNAc2 | Man5 | 1257.4 | 63.2 | 80.7 | 85.2 |
| Hex6HexNAc2 | Man6 | 1419.5 | 13.9 | 4.2 | 2.5 |
| Hex7HexNAc2 | Man7 | 1581.5 | 8.0 | 4.2 | 3.6 |
| Hex8HexNAc2 | Man8 | 1743.6 | 9.0 | 6.9 | 6.7 |
| Hex9HexNAc2 | Man9 | 1905.6 | 5.9 | 2.3 | 1.9 |
| Hex10HexNAc2 | Man10 | 2067.7 | 0.0 | 1.7 | 0.0 |

TABLE 38

Relative proportions of the neutral N-glycans from purified MAB01 antibody from strain M507 fermented in YE medium.

| Composition | Short | m\z | d3 % | d4 % | d5 % |
|---|---|---|---|---|---|
| Hex5HexNAc2 | Man5 | 1257.4 | 20.6 | 23.9 | 33.0 |
| Hex6HexNAc2 | Man6 | 1419.5 | 16.1 | 20.2 | 21.6 |
| Hex7HexNAc2 | Man7 | 1581.5 | 26.4 | 26.1 | 22.5 |
| Hex8HexNAc2 | Man8 | 1743.6 | 24.1 | 19.1 | 14.2 |
| Hex9HexNAc2 | Man9 | 1905.6 | 12.7 | 10.8 | 8.7 |
| Hex10HexNAc2 | Man10 | 2067.7 | 0.0 | 0.0 | 0.0 |

Example 10

Generation of GnT1 Strains M1088-M1099 Producing MAB01

This example describes the generation of *T. reesei* strain with the following characteristics:

- it is deficient for pep1, tsp1, slp1, ga1, gap2, pep4, pep3 protease genes,
- it comprises GnTI gene from either *P. tricornutum*, *Xenopus* (see SEQ ID NO:465 for the codon optimized sequence and SEQ ID NO:466 for the corresponding translated sequence, SEQ ID NO:467 for the codon optimized sequence with KRE2 targeting signal and SEQ ID NO:468 for the corresponding translated sequence), *Drosophila* (see SEQ ID NO:469 for the full-length codon optimized sequence and SEQ ID NO:470 for corresponding translated sequence) or *Arabidopsis* (see SEQ ID NO:471 for the full-length codon optimized sequence and SEQ ID NO:472 for corresponding translated sequence).

The resulting strains M1088/M1099 with *P. tricornutum* GnTI gene produce MAB01 with optimal 79.8% GlcNAc-Man5 glycoform.

Cloning of six GNT1 expression plasmids. All six plasmids contain a common Golgi targeting signal; 85 amino acids from *T. reesei* KRE2 (tre21576). The targeting signal is followed by GNT1 gene with N-terminal truncation. The origins of GNT1 genes and the lengths of N-terminal truncations are listed in Table 39. Constructs are expressed from gpdA promoter, followed by cbh1 terminator. Expression cassettes are targeted to egl2 locus (tre120312) and contain pyr4-hygR double selection cassette with egl2 3DR for marker removal. GNT1 genes are synthetic genes.

Vector backbone pTTv361 used to clone GNT1 expression vectors contains pRS426 backbone, egl2 (tre120312) 5' and 3'flanking regions for targeted integration to the *T. reesei* genome, pyr4-hygR double selection cassette and egl2 3DR for marker removal. pTTv361 was cloned using pTTv264 as backbone vector. Plasmid pTTv264 (described in PCT/EP2013/050126) contains integration flanks for egl2 (tre120312) locus, gpdA promoter, cbh1 terminator and hygromycin marker. The plasmid was digested with NotI and both two resulting fragments were utilised in cloning pTTv361. egl2 3DR and pyr4 marker were produced by PCR using primers listed in Table 39. Template for both fragments was *T. reesei* wild type strain QM6a (ATCC13631). PCR products and digested vector fragments were separated using agarose gel electrophoresis. Correct fragments were isolated from the gel with a gel extraction kit (Qiagen) essentially according to manufacturer's protocol. The plasmid was constructed with the fragments described above using yeast homologous recombination method as described in PCT/EP2013/050126. Plasmid was rescued from yeast and transformed to *E. coli*. A few clones were selected, plasmid DNAs isolated and sequenced. One clone was selected and stored.

For cloning GNT1 expression plamids pTTv361 was linearised with PacI and treated with phosphatase to prevent self-ligation. KRE2 Golgi targeting fragment and the six GNT1 genes were produced by PCR using primers listed in Table 40. Template for KRE2 (tre21576) was *T. reesei* wild type strain QM6a (ATCC13631). Templates for GNT1's were commercial synthetic plasmids. PCR products and digested vector backbone were separated using agarose gel electrophoresis. Correct fragments were isolated from the gel with a gel extraction kit (Qiagen) essentially according to manufacturer's protocol. The plasmids were constructed with the fragments described above using yeast homologous recombination method as described in WO2013/102674. Plasmids were rescued from yeast and transformed to *E.*

*coli*. A few clones were selected, plasmid DNAs isolated and sequenced. One clone per plasmid was selected and stored (Table 39).

TABLE 39

Outline of six GNT1 expression constructs with KRE2 (tre21576) Golgi targeting signal. N-terminal truncations of the GNT1 proteins are indicated.

| Targeting | Origin of GNT1, Δaa from N-terminus | Plasmid |
|---|---|---|
| KRE2 (tre21576) 85 aa | *Xenopus laevis* GNT1, Δ66 aa | pTTv407 |
| KRE2 (tre21576) 85 aa | *Drosophila melanogaster* GNT1, Δ86 aa | pTTv408 |
| KRE2 (tre21576) 85 aa | *Arabidopsis thaliana* GNT1, Δ75 aa | pTTv409 |
| KRE2 (tre21576) 85 aa | *Caenorhabditis elegans* GNT1, Δ41 aa (see SEQ ID NO: 473 full-length optimized sequence and SEQ ID NO: 474 for corresponding translated sequence) | pTTv410 |
| KRE2 (tre21576) 85 aa | *Spodoptera frugiperda* GNT1, Δ73 aa (see SEQ ID NO: 475 full-length optimized sequence and SEQ ID NO: 476 for corresponding translated sequence) | pTTv411 |
| KRE2 (tre21576) 85 aa | *Phaeodactylum tricornutum* GNT1, Δ53 aa (see SEQ ID NO: 477 full-length optimized sequence) | pTTv412 |

TABLE 39b

Primers used to produce fragments for cloning backbone vector pTTv361.

| Product | Primer | Sequence |
|---|---|---|
| egl2 3DR | T1367_egl2_3dr_for | TCCGTTGCGAGGCCAACTTGCATTGCTGTCAAGACGATGAGGATCCCACTCTGAGCTGAATGCAGA (SEQ ID NO: 651) |
| | T1368_egl2_3dr_rev | GCGCTGGCAACGAGAGCAGAGCAGCAGTAGTCGATGCTAGGCGGCCGCTGCGACAACTACGGATGC (SEQ ID NO: 652) |
| pyr4 | T1369_pyr4_for | CTAGCATCGACTACTGCTGC (SEQ ID NO: 653) |
| | T1370_pyr4_rechphnew_rev | AAGGGGACCGGCCGCTAGTCTCACCGTTATCATGCAAAGATACACATCAA (SEQ ID NO: 654) |

TABLE 40

Primers used to produce fragments for cloning six different GNT1 expression plasmids pTTv407 to pTTv412.

| Product | Primer | Sequence |
|---|---|---|
| Xl GNT1 pTTv407 | T1529_T141del66_for | CAACGACCTCGTCGGCATCGCTCCCGGCCCTCGAATGAACAGCGGCCTGCTCAACCAGCA (SEQ ID NO: 655) |
| | T1530_T141_rev | CCAAGAATCTACCGGTGCGTCAGGCTTTCGCCACGGAGCTTTAGGTCCAGAGGGGGTCGT (SEQ ID NO: 656) |
| Dm GNT1 pTTv408 | T1531_T142del86_for | CAACGACCTCGTCGGCATCGCTCCCGGCCCTCGAATGAACGCCGCCGAGATCAGCGCCGA (SEQ ID NO: 657) |
| | T1532_T142_rev | CCAAGAATCTACCGGTGCGTCAGGCTTTCGCCACGGAGCTTTAGGACCAGCTCAGCTCGT (SEQ ID NO: 658) |
| At GNT1 pTTv409 | T1533_T143del75_for | CAACGACCTCGTCGGCATCGCTCCCGGCCCTCGAATGAACGACGAGGAACTCGTCCAGCT (SEQ ID NO: 659) |
| | T1534_T143_rev | CCAAGAATCTACCGGTGCGTCAGGCTTTCGCCACGGAGCTTTAGCTGTTGCGGATGCCGA (SEQ ID NO: 660) |
| Ce GNT1 pTTv410 | T1535_T144del41_for | CAACGACCTCGTCGGCATCGCTCCCGGCCCTCGAATGAACAACACCGCCATCCACGCCCC (SEQ ID NO: 661) |
| | T1536_T144_rev | CCAAGAATCTACCGGTGCGTCAGGCTTTCGCCACGGAGCTTTAGACGACGAGCATCTCGC (SEQ ID NO: 662) |
| Sf GNT1 pTTv411 | T1537_T154del73_for | CAACGACCTCGTCGGCATCGCTCCCGGCCCTCGAATGAACATCAGCGAGGGCGAGAACGT (SEQ ID NO: 663) |
| | T1538_T145_rev | CCAAGAATCTACCGGTGCGTCAGGCTTTCGCCACGGAGCTTTAGCCCCAGGTGGGGTCGT (SEQ ID NO: 664) |
| Pt GNT1 pTTv412 | T1539_T146del53_for | CAACGACCTCGTCGGCATCGCTCCCGGCCCTCGAATGAACACCAAGAGCGTCCCCACCTT (SEQ ID NO: 665) |
| | T1540_T146_rev | CCAAGAATCTACCGGTGCGTCAGGCTTTCGCCACGGAGCTTTAGCGCTTGGGGCTGGGA (SEQ ID NO: 666) |

TABLE 40-continued

Primers used to produce fragments for cloning six different GNT1 expression plasmids pTTv407 to pTTv412.

| Product | Primer | Sequence |
|---|---|---|
| KRE2 85 aa | T1372_kre2_recgpda_for | ACTAACAGCTACCCCGCTTGAGCAGACATCAT GGCGTCAACAAATGCGCG (SEQ ID NO: 667) |
|  | T337_21576_r | GTTCATTCGAGGGCCGGGAG (SEQ ID NO: 668) |

Transformation into MAB01 strain M564 (M1088-M1099). GNT1 expression plasmids pTTv407 to pTTv412 were digested with MssI to release the fragment for targeted integration and separated with agarose gel electrophoresis. Approximately 7 µg of purified fragment was used to transform protoplasts of MABO1 producing strain M564 (pyr4– of M507, see WO2013/102674). Preparation of protoplasts and transformations were carried out essentially as described in WO2013/102674 using pyr4-hygR selection. Half of the transformation mixtures were plated using the standard plating method and the other half using the double top plating method described in the new protease patent application.

Transformants were streaked onto selective plates. Growing clones were screened for correct integration by PCR using primers listed in Table 40. Clones giving expected signals were purified to single cell clones and rescreened for correct integration and clone purity by PCR using primers listed in Table 41. Selected clones were streaked onto selective plates for preliminary glycan analyses. Based on glycan analysis, potential candidates were repurified and screened by PCR using primers listed in Table 41.

TABLE 41

Primers used in screening correct integration of the six GNT1 expression plasmids (pTTv407 to pTTv412 above) to the genome and clone purity.

| Product | Primer | Sequence |
|---|---|---|
| 5int | T1410_egl2_5int_f3 | GCTCGAGACGTACGATTCAC (SEQ ID NO: 669) |
|  | T018_pgpdA_5rev | GAGCAGGCTCGACGTATTTC (SEQ ID NO: 670) |
| 3int | T1158_egl2_3pr_intR2 | GGCGAAATAAGCTCACTCAG (SEQ ID NO: 671) |
|  | T1479_egl2_3int_r3 | CGTTGTTGACTGGAAAAAGG (SEQ ID NO: 672) |
|  | T1411_cbh2t_end_f | CCAATAGCCCGGTGATAGTC (SEQ ID NO: 673) |
| ORF del | T1412_egl2_orf_f1 | AACAAGTCCGTGGCTCCATT (SEQ ID NO: 674) |
|  | T1413_egl2_orf_r1 | CCAACTTTTCAGCCAGCAAC (SEQ ID NO: 675) |
|  | T1414_egl2_orf_f2 | GCTCACTCAGGAACTGAGAA (SEQ ID NO: 676) |
|  | T1415_egl2_orf_r2 | CTCGACTGAGATGCGTACTT (SEQ ID NO: 677) |

Shake flask cultivation of GNT1 expressing clones. After two purification rounds, selected clones from the six transformations above were grown in shake flasks. Parental strain M507 (MAB01, Δ7 proteases) and control strain M706 with human GNT1 (MAB01, (Kre2)huGNT1, Δ7 proteases) were included. Cultivation was carried out on TrMM—40 g/l lactose—20 g/l SGE—9 g/l casamino acids—100 mM PIPPS, pH 5.5 medium using standard inoculation ratio at +28° C., 200 rpm for seven days. Samples were collected by vacuum filtration on days 3, 5 and 7 for protein, pH and biomass analyses. Supernatant samples were stored at −20° C. and analysed for glycans.

No significant differences in growth between the transformants and the parental strain M507 or control strain M706 were observed. Two or three clones from each transformation were stored (Table 42).

Stored clones were analysed by Southern hybridisation using standard methods for $^{32}P$ radiolabelling as described in WO2013/102674. Clones with Xenopus laevis GNT1 fusion protein (pTTv407) contained most likely an additional copy of the expression cassette in the genome. Other strains were single integrants.

TABLE 42

List of GNT1 clones cultivated in shake flasks and strains stored (M-numbers).

| Plasmid | Origin of GNT1 | Clone | Strain |
|---|---|---|---|
| pTTv407 | Xenopus laevis | 68-19-4-3 | M1088 |
|  |  | 68-19-4-4 | M1089 |

TABLE 42-continued

List of GNT1 clones cultivated in shake flasks and strains stored (M-numbers).

| Plasmid | Origin of GNT1 | Clone | Strain |
|---|---|---|---|
| pTTv408 | Drosophila melanogaster | 69-26-1-2 | M1090 |
|  |  | 69-26-2-1 | M1091 |

TABLE 42-continued

List of GNT1 clones cultivated in shake flasks and strains stored (M-numbers).

| Plasmid | Origin of GNT1 | Clone | Strain |
|---|---|---|---|
| pTTv409 | Arabidopsis thaliana | 70-15-1-1 | M1092 |
|  |  | 70-15-5-1 | M1093 |
| pTTv410 | Caenorhabditis elegans | 71-9-4-2 | M1094 |
|  |  | 71-17-6-2 | M1095 |
|  |  | 71-55-8-1 |  |
| pTTv411 | Spodoptera frugiperda | 72-1-4-3 |  |
|  |  | 72-14-3-1 | M1096 |
|  |  | 72-26-1-1 |  |
|  |  | 72-31-3-1 | M1097 |
| pTTv412 | Phaeodactylum tricornutum | 73-12-3-1 | M1098 |
|  |  | 73-76-2-2 | M1099 |
|  |  | 73-76-1-3 | M1175 |

Shake flask cultures. Transformants with GnTI from different species were cultured in shake flasks in TrMM, 40 g/l lactose, 20 g/l spent grain extract, 9 g/l casamino acids, 100 mM PIPPS, pH 5.5. Neutral N-glycans from purified antibody samples from day 5 and 7 were analysed. The results are shown in Table 43. The best product level was obtained with GnTI from *P. tricornutum*.

TABLE 43

Relative proportions (%) of the predominant neutral N-glycans from purified antibody from GnTI transformants cultured in shake flasks.

|  | pTTv407; X. laevis #68-19-4-3 | | pTTv407; X. laevis #68-19-4-4 | | pTTv408; D. melanogaster #69-26-1-2 | | pTTv408; D. melanogaster #69-26-2-1 | |
|---|---|---|---|---|---|---|---|---|
|  | d5 % | d7 % | d5 % | d7 % | d5 % | d7 % | d5 % | d7 % |
| Man4 | 0.0 | 0.0 | 0.0 | 0.0 | 0.0 | 0.0 | 0.0 | 0.0 |
| Man5 | 5.8 | 12.5 | 3.7 | 10.1 | 16.5 | 25.1 | 16.8 | 31.4 |
| Man6 | 15.2 | 10.3 | 12.8 | 11.8 | 16.2 | 9.7 | 16.2 | 17.5 |
| GnMan5 | 62.5 | 62.8 | 42.3 | 61.6 | 36.5 | 54.7 | 20.7 | 30.3 |
| Man7 | 9.4 | 7.5 | 21.8 | 9.6 | 17.2 | 6.0 | 26.0 | 13.1 |
| GnMan6 | 3.0 | 1.4 | 3.5 | 1.7 | 1.6 | 0.9 | 1.9 | 0.8 |
| Man8 | 4.0 | 4.5 | 9.4 | 3.8 | 7.4 | 2.6 | 10.4 | 4.4 |
| Man9 | 0.0 | 1.0 | 6.1 | 1.4 | 4.3 | 1.0 | 7.4 | 2.1 |
| Man10 | 0.0 | 0.0 | 0.5 | 0.0 | 0.3 | 0.0 | 0.6 | 0.2 |

|  | pTTv409; A. thaliana #70-15-1-1 | | pTTv409; A. thaliana #70-15-5-1 | | pTTv410; C. elegans #71-9-4-2 | | pTTv410; C. elegans #71-17-6-2 | |
|---|---|---|---|---|---|---|---|---|
|  | d5 % | d7 % | d5 % | d7 % | d5 % | d7 % | d5 % | d7 % |
| Man4 | 0.0 | 0.0 | 0.7 | 0.0 | 0.3 | 0.0 | 0.0 | 0.0 |
| Man5 | 41.3 | 40.7 | 43.6 | 40.7 | 49.7 | 60.7 | 38.3 | 34.9 |
| Man6 | 15.8 | 10.1 | 16.6 | 10.1 | 18.0 | 10.4 | 25.0 | 19.2 |
| GnMan5 | 32.2 | 36.1 | 27.0 | 36.1 | 16.2 | 16.5 | 5.3 | 3.8 |
| Man7 | 7.3 | 8.0 | 7.7 | 8.0 | 10.5 | 7.6 | 21.3 | 24.3 |
| GnMan6 | 0.5 | 0.7 | 0.6 | 0.7 | 0.4 | 0.0 | 0.0 | 0.0 |
| Man8 | 2.3 | 3.1 | 3.1 | 3.1 | 3.8 | 3.5 | 6.1 | 9.3 |
| Man9 | 0.5 | 1.2 | 0.7 | 1.2 | 1.1 | 1.3 | 4.0 | 8.0 |
| Man10 | 0.0 | 0.0 | 0.0 | 0.0 | 0.0 | 0.0 | 0.0 | 0.4 |

|  | pTTv410; C. elegans #71-55-8-1 | | pTTv411; S. frugiperda #72-1-4-3 | | pTTv411; S. frugiperda #72-14-3-1 | | pTTv411; S. frugiperda #72-26-1-1 | |
|---|---|---|---|---|---|---|---|---|
|  | d5 % | d7 % | d5 % | d7 % | d5 % | d7 % | d5 % | d7 % |
| Man4 | 0.0 | 0.0 | 0.0 | 0.0 | 0.0 | 0.0 | 0.0 | 0.0 |
| Man5 | 40.4 | 48.8 | 20.9 | 29.3 | 21.4 | 30.8 | 23.4 | 28.4 |
| Man6 | 17.6 | 18.5 | 17.1 | 13.4 | 16.5 | 13.0 | 15.8 | 10.7 |
| GnMan5 | 7.4 | 8.5 | 34.1 | 40.6 | 26.6 | 37.9 | 43.4 | 42.7 |
| Man7 | 21.5 | 14.7 | 16.7 | 9.8 | 19.8 | 10.7 | 10.4 | 10.7 |
| GnMan6 | 0.0 | 0.0 | 1.4 | 1.1 | 1.4 | 1.0 | 1.5 | 0.0 |
| Man8 | 7.2 | 5.6 | 6.2 | 4.2 | 8.5 | 4.8 | 4.0 | 5.0 |
| Man9 | 5.6 | 4.0 | 3.5 | 1.6 | 5.3 | 1.7 | 1.5 | 2.4 |
| Man10 | 0.3 | 0.0 | 0.0 | 0.0 | 0.5 | 0.0 | 0.0 | 0.0 |

TABLE 43-continued

Relative proportions (%) of the predominant neutral N-glycans from purified antibody from GnTI transformants cultured in shake flasks.

| | pTTv411; S. frugiperda #72-31-3-1 | | pTTv412; P. tricornutum #73-12-3-1 | | pTTv412; P. tricornutum #73-76-1-3 | | pTTv412; P. tricornutum #73-76-2-2 | |
|---|---|---|---|---|---|---|---|---|
| | d5 % | d7 % | d5 % | d7 % | d5 % | d7 % | d5 % | d7 % |
| Man4 | 0.0 | 0.4 | 0.0 | 0.0 | 0.0 | 0.0 | 0.0 | 0.0 |
| Man5 | 26.7 | 35.6 | 8.2 | 11.0 | 16.5 | 13.3 | 5.3 | 11.0 |
| Man6 | 18.1 | 11.7 | 11.1 | 7.9 | 14.3 | 10.3 | 14.1 | 10.8 |
| GnMan5 | 37.2 | 38.6 | 63.6 | 70.7 | 52.5 | 63.0 | 59.6 | 62.9 |
| Man7 | 11.5 | 8.4 | 9.0 | 5.5 | 9.7 | 8.3 | 10.9 | 8.5 |
| GnMan6 | 1.6 | 0.8 | 2.2 | 1.3 | 1.8 | 1.3 | 2.5 | 1.9 |
| Man8 | 3.6 | 3.7 | 4.6 | 2.9 | 3.7 | 2.9 | 5.8 | 3.9 |
| Man9 | 1.3 | 0.8 | 1.5 | 0.6 | 1.5 | 1.0 | 1.9 | 1.0 |
| Man10 | 0.0 | 0.2 | 0.0 | 0.0 | 0.0 | 0.0 | 0.0 | 0.0 |

Figure 13:
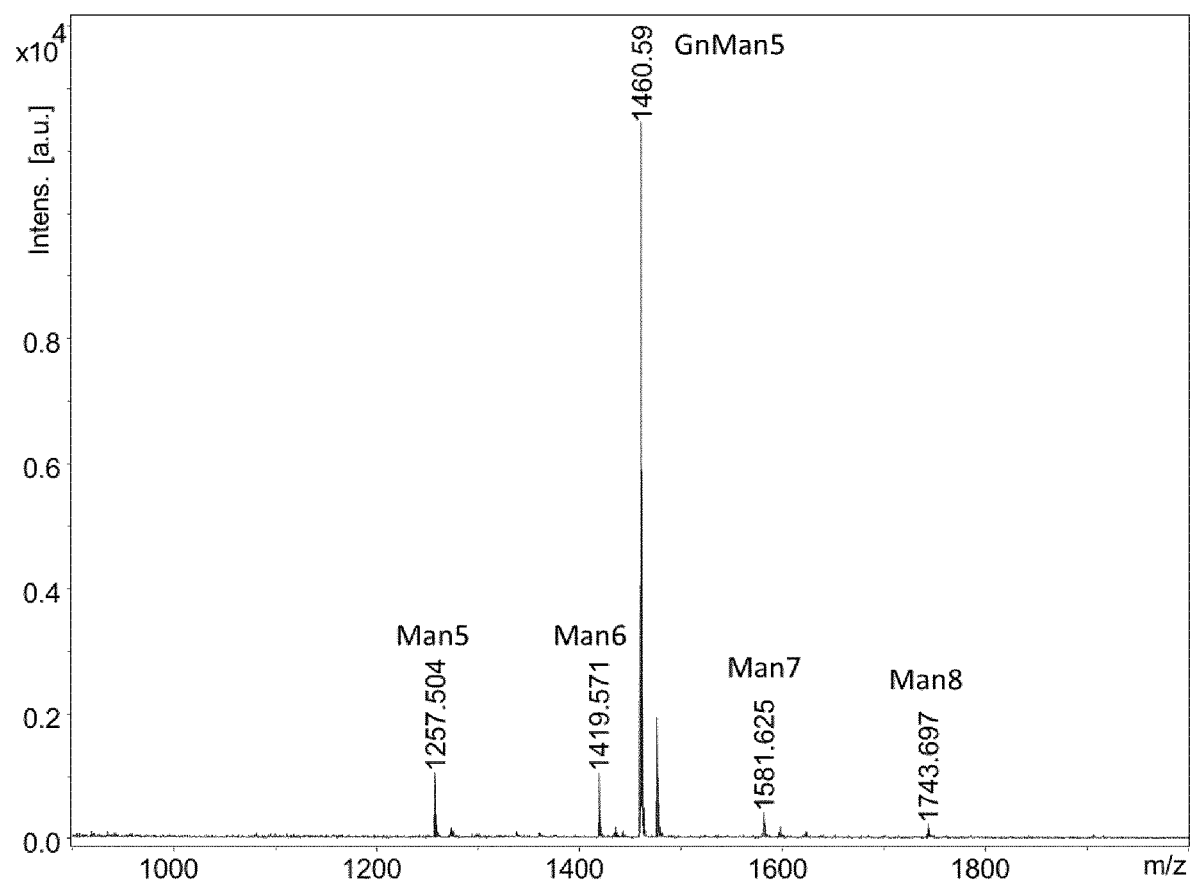
FIG. 13. MALDI-TOF MS image of neutral N-glycans released from antibody from strain M1098 (*P. tricornutum*) fermented in for 5 days in WSG.
Figure 14:
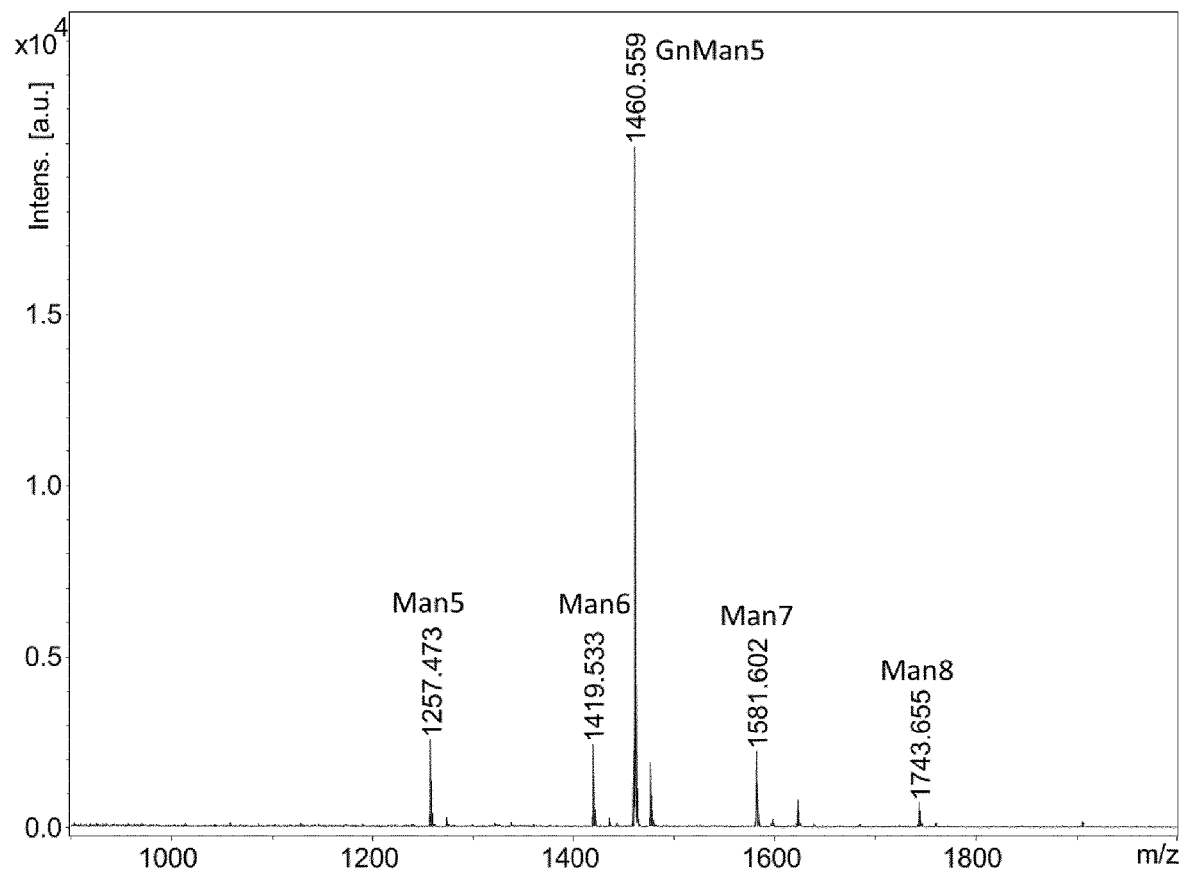
FIG. 14. MALDI-TOF MS image of neutral N-glycans released from antibody from strain M1088 (*X. laevis*) fermented in for 4 days in WSG.

Fermentations. Transformants with GnTI from different species were fermented in 4% WSG, 2% Glc, 4% cellobiose, 6% Lac and some strains also in fed-batch in 2% YE, 12% cellulose, 2% glucose with 50% glucose, 12.5% sorbose feed. Sampling was performed at days 3-6. Antibody titers were at day six in range of 2-3.3 g/L (WSG batch) and in range of 1.4-4.4 g/L (YE). N-glycan analysis to purified antibody was essentially performed as described in WO2013/102674 and the results are shown in Tables 44. The best product level was obtained with GnTI from P. tricornutum fermented in WSG. FIGS. 13 and 14 show MALDI-TOF images of the fermented M1098 (P. tricornutum) and M1088 (X. laevis) neutral N-glycans from day 5 and 4, respectively.

TABLE 44

Relative proportions (%) of the predominant neutral N-glycans from purified MAB01 antibody from GnTI strain M1088 (X. laevis, #68-19-4-3) fermented in WSG.

| | | | M1088 | | | |
|---|---|---|---|---|---|---|
| Composition | Short | m\z | d3 % | d4 % | d5 % | d6 % |
| Man4 | H4N2 | 1095.37 | 0.0 | 0.0 | 0.0 | 0.0 |
| Man5 | H5N2 | 1257.42 | 4.6 | 8.9 | 20.6 | 31.3 |
| GnMan4 | H4N3 | 1298.45 | 0.0 | 0.0 | 0.0 | 0.0 |
| Man6 | H6N2 | 1419.48 | 10.0 | 8.4 | 8.5 | 6.4 |
| GnMan5 | H5N3 | 1460.50 | 58.9 | 69.0 | 63.9 | 49.0 |
| Man7 | H7N2 | 1581.53 | 13.1 | 7.7 | 4.0 | 6.9 |
| GnMan6 | H6N3 | 1622.56 | 3.6 | 2.8 | 0.8 | 0.8 |
| Man8 | H8N2 | 1743.58 | 7.2 | 2.5 | 1.7 | 3.6 |
| Man9 | H9N2 | 1905.63 | 1.8 | 0.7 | 0.4 | 2.0 |
| Man10 | H10N2 | 2067.69 | 0.8 | 0.0 | 0.0 | 0.0 |

TABLE 45

Relative proportions (%) of the predominant neutral N-glycans from purified antibody from GnTI strains M1090 and M1091 (D. melanogaster, #69-26-1-2 and #69-26-2-1, respectively) fermented in WSG.

| | | | M1090 | | | | M1091 | | | |
|---|---|---|---|---|---|---|---|---|---|---|
| Composition | Short | m\z | d3 % | d4 % | d5 % | d6 % | d3 % | d4 % | d5 % | d6 % |
| Man4 | H4N2 | 1095.37 | 0.0 | 0.0 | 0.3 | 0.5 | 0.0 | 0.3 | 0.0 | 0.3 |
| Man5 | H5N2 | 1257.42 | 14.8 | 31.6 | 44.3 | 44.2 | 10.4 | 27.0 | 39.8 | 52.3 |
| GnMan4 | H4N3 | 1298.45 | 0.0 | 0.0 | 0.0 | 0.0 | 0.0 | 0.2 | 0.0 | 0.0 |
| Man6 | H6N2 | 1419.48 | 13.0 | 10.6 | 7.5 | 7.6 | 11.7 | 11.7 | 8.9 | 4.9 |
| GnMan5 | H5N3 | 1460.50 | 55.7 | 50.7 | 38.0 | 28.0 | 55.2 | 50.1 | 44.6 | 33.3 |
| Man7 | H7N2 | 1581.53 | 10.3 | 4.4 | 5.4 | 11.2 | 12.4 | 6.9 | 4.1 | 4.9 |
| GnMan6 | H6N3 | 1622.56 | 2.3 | 0.6 | 0.3 | 0.4 | 3.8 | 1.1 | 0.4 | 0.2 |
| Man8 | H8N2 | 1743.58 | 3.4 | 1.7 | 2.7 | 4.3 | 4.7 | 2.4 | 1.8 | 2.9 |
| Man9 | H9N2 | 1905.63 | 0.5 | 0.4 | 1.2 | 3.4 | 1.8 | 0.4 | 0.4 | 1.1 |
| Man10 | H10N2 | 2067.69 | 0.0 | 0.0 | 0.1 | 0.5 | 0.0 | 0.0 | 0.0 | 0.1 |

TABLE 46

Relative proportions (%) of the predominant neutral N-glycans from purified antibody from GnTI strain M1092 (*A. thaliana*; #70-15-1-1) fermented in WSG.

|             |       |         | M1092   |         |         |         |
|-------------|-------|---------|---------|---------|---------|---------|
| Composition | Short | m\z     | d3 %    | d4 %    | d5 %    | d6 %    |
| Man4        | H4N2  | 1095.37 | 0.0     | 0.0     | 0.3     | 0.0     |
| Man5        | H5N2  | 1257.42 | 6.9     | 10.7    | 23.1    | 40.1    |
| GnMan4      | H4N3  | 1298.45 | 0.0     | 0.0     | 0.3     | 0.0     |
| Man6        | H6N2  | 1419.48 | 13.9    | 9.6     | 7.9     | 3.6     |
| GnMan5      | H5N3  | 1460.50 | 54.0    | 70.2    | 61.7    | 51.0    |
| Man7        | H7N2  | 1581.53 | 13.9    | 5.6     | 4.0     | 3.3     |
| GnMan6      | H6N3  | 1622.56 | 4.2     | 1.9     | 0.7     | 0.0     |
| Man8        | H8N2  | 1743.58 | 5.6     | 1.7     | 1.8     | 2.0     |
| Man9        | H9N2  | 1905.63 | 1.6     | 0.4     | 0.2     | 0.0     |
| Man10       | H10N2 | 2067.69 | 0.0     | 0.0     | 0.0     | 0.0     |

TABLE 47

Relative proportions (%) of the predominant neutral N-glycans from purified antibody from GnTI strain M1094 (*C. elegans*, #71-9-4-2) fermented in WSG.

|             |       |         | M1094 |      |      |      |
|-------------|-------|---------|-------|------|------|------|
| Composition | Short | m\z     | d3 %  | d4 % | d5 % | d6 % |
| Man4        | H4N2  | 1095.37 | 0.0   | 0.4  | 0.5  | 0.5  |
| Man5        | H5N2  | 1257.42 | 42.7  | 55.3 | 71.0 | 63.3 |
| GnMan4      | H4N3  | 1298.45 | 0.0   | 0.0  | 0.0  | 0.0  |
| Man6        | H6N2  | 1419.48 | 17.5  | 13.6 | 8.9  | 7.9  |
| GnMan5      | H5N3  | 1460.50 | 17.6  | 19.5 | 13.7 | 8.9  |
| Man7        | H7N2  | 1581.53 | 14.7  | 8.0  | 3.9  | 11.2 |
| GnMan6      | H6N3  | 1622.56 | 1.0   | 0.6  | 0.0  | 0.0  |
| Man8        | H8N2  | 1743.58 | 5.5   | 2.1  | 1.7  | 4.4  |
| Man9        | H9N2  | 1905.63 | 1.0   | 0.5  | 0.3  | 3.6  |
| Man10       | H10N2 | 2067.69 | 0.0   | 0.0  | 0.0  | 0.3  |

TABLE 48

Relative proportions (%) of the predominant neutral N-glycans from purified antibody from GnTI strain M1096 (*S. frugiperda*, #72-14-3-1) fermented in WSG.

|             |       |         | M1096 |      |      |      |
|-------------|-------|---------|-------|------|------|------|
| Composition | Short | m\z     | d3 %  | d4 % | d5 % | d6 % |
| Man4        | H4N2  | 1095.37 | 0.0   | 0.4  | 0.4  | 0.4  |
| Man5        | H5N2  | 1257.42 | 22.9  | 48.9 | 63.9 | 76.9 |
| GnMan4      | H4N3  | 1298.45 | 0.0   | 0.0  | 0.0  | 0.0  |
| Man6        | H6N2  | 1419.48 | 18.4  | 12.7 | 8.0  | 4.1  |
| GnMan5      | H5N3  | 1460.50 | 31.7  | 27.1 | 22.1 | 12.7 |
| Man7        | H7N2  | 1581.53 | 17.1  | 7.2  | 3.7  | 3.6  |
| GnMan6      | H6N3  | 1622.56 | 2.5   | 0.7  | 0.2  | 0.0  |
| Man8        | H8N2  | 1743.58 | 5.3   | 2.4  | 1.3  | 1.6  |
| Man9        | H9N2  | 1905.63 | 2.0   | 0.6  | 0.2  | 0.6  |
| Man10       | H10N2 | 2067.69 | 0.0   | 0.0  | 0.0  | 0.2  |

TABLE 49

Relative proportions (%) of the predominant neutral N-glycans from purified antibody from GnTI strain M1098 (*P. tricornutum*, #73-12-3-1) fermented in WSG.

|             |       |         | M1098 |      |      |      |
|-------------|-------|---------|-------|------|------|------|
| Composition | Short | m\z     | d3 %  | d4 % | d5 % | d6 % |
| Man4        | H4N2  | 1095.37 | 0.0   | 0.0  | 0.0  | 0.0  |
| Man5        | H5N2  | 1257.42 | 1.6   | 3.3  | 7.4  | 16.3 |
| GnMan4      | H4N3  | 1298.45 | 0.0   | 0.0  | 0.0  | 0.8  |
| Man6        | H6N2  | 1419.48 | 10.4  | 8.6  | 7.4  | 3.1  |
| GnMan5      | H5N3  | 1460.50 | 62.5  | 76.0 | 79.8 | 75.2 |
| Man7        | H7N2  | 1581.53 | 13.9  | 6.6  | 2.9  | 2.9  |
| GnMan6      | H6N3  | 1622.56 | 5.1   | 2.7  | 0.9  | 0.0  |
| Man8        | H8N2  | 1743.58 | 5.2   | 2.8  | 1.7  | 1.7  |
| Man9        | H9N2  | 1905.63 | 1.3   | 0.0  | 0.0  | 0.0  |
| Man10       | H10N2 | 2067.69 | 0.0   | 0.0  | 0.0  | 0.0  |

Cloning of Golgi localisation series of *Phaeodactylum tricornutum* GNT1. *Phaeodactylum tricornutum* GNT1 enzyme was shown to have high activity in *T. reesei*, and it was expressed with different Golgi localisation signals. The expression constructs expressing *P. tricornutum* GNT1 with different localisation signals, pTTv484, pTTv485, pTTv493 to 497, were constructed as follows:

Vectors pTTv412 and pTTv274 were digested with NotI and dephosphorylated with alkaline phosphatase (both from Fermentas). The vector pTTv223 (described in WO/2013/102674 and WO/2013/174927) was digested with NotI as well and the AmdS marker fragment was eluted from agarose gel. The digested and eluted vectors pTTv412 and pTTv274 were ligated with the AmdS from pTTv223. TOP10 *E. coli* were transformed with these ligation and plated on LB amp+ agar plates. Positive clones for both were identified by colony PCRs and sequenced (Table 50).

TABLE 50

Oligonucleotides used in colony PCR for identifying correct constructs.

| T44  | CCTGGAAAGCACTGTTGGAG  |
|------|-----------------------|
| T25  | AAGGCGGTTAGTGAGCTTGA  |
| T44  | CCTGGAAAGCACTGTTGGAG  |
| T681 | GCAGCCTGCAGTCAAACATA  |

Correct clones were given numbers pTTv484 (pTTv412 with AmdS) and pTTv485 (pTTv274 with AmdS). Vector pTTv484 contains the Golgi targeting signal sequence of Kre2 N-terminal to PtGnT1 catalytic domain, pTTv485 has the GnT2 Golgi targeting signal sequence N-terminal to human GnT1.

Vector pTTv412 was digested with SalI (Fermentas) and a yeast recombination cloning was performed using the digested vector and PCR products for gpdA promoter and PtGnT1. Primers used are listed in Table 51.

TABLE 51

Primers used for making pTTv493.

1779
ACTAACAGCTACCCCGCTTGAGCAGACATCTTAATTAAATGACCAAGAGC
GTCCCCACCTT for PtGnT1 (SEQ ID NO: 678)

TABLE 51-continued

Primers used for making pTTv493.

1780
ACCGGTGCGTCAGGCTTTCGCCACGGAGCTATTTAAATTTAGCGCTTGGG
GCTGGGGATG (SEQ ID NO: 679)

1781
GCCAGCGGCGCAGACCGGGA
for gpdA promoter part (SEQ ID NO: 680)

1782
GATGTCTGCTCAAGCGGGGT (SEQ ID NO: 681)

The plasmid rescued from yeast was used to transform *E. coli* Top10. Plasmids were prepared from 5 ml LBamp+ cultures and positive clones were identified by digesting with PacI and by sequencing with the primer T794 (CAG-TATATTCATCTTCCCATCC (SEQ ID NO:682)). The resulting plasmid was named as pTTv493.

The Golgi targeting signals from human GnT2, *T. reesei* Anp1 and *T. reesei* Sec12 were integrated by using the yeast recombination system as above. PCRs of targeting signals (Table 52) and pTTv493 linearized with PacI were transformed to yeast strain H3488. The yeast transformation mixture was plated on SCDURA plates and plasmids were rescued and used to transform Top10 *E. coli*. The forward primer of the corresponding targeting signals and T1552 were used to screen for correct clones (Table 52).

TABLE 52

Primers used to screen correct Golgi localisation expression plasmids.

1783
TAACAGCTACCCCGCTTGAGCAGACATCATGCGCTTCCGAATCTACAAG
for GnT2 (SEQ ID NO: 683)

1784
GACGGTGGGAAAGGTGGGGACGCTCTTGGTGGGGTGATCCCCTCCCCTG
(SEQ ID NO: 684)

1787
TAACAGCTACCCCGCTTGAGCAGACATCATGATGCCACGGCATCACTC
for Anp1 (SEQ ID NO: 685)

1788
GACGGTGGGAAAGGTGGGGACGCTCTTGGTTTCGAGCTTCAGGTCATCGT
(SEQ ID NO: 686)

1789
TAACAGCTACCCCGCTTGAGCAGACATCATGGCCTCTTCTTCAAAGAC
for Sec12 (SEQ ID NO: 687)

1790
GACGGTGGGAAAGGTGGGGACGCTCTTGGTGAGGTATTCCTTGTTGAATG
(SEQ ID NO: 688)

T1552
AGGCCAGGGAAGAAGTCG
for colony PCR (SEQ ID NO: 689)

Positive clones were sequenced and given the numbers pTTv494 (GnT2), pTTv496 (Anp1) and pTTv497 (Sec12). The amino acid sequences of Tricornutum GnTI with different targeting signals and human GnTI with GnT2 targeting signal are listed in table 53.

TABLE 53

| Vector | Notes | Targeting signal sequence | GnTI sequence |
|---|---|---|---|
| pTTv484 | Kre2 targeting | MASTNARYVRYLLIAFFTILVF YFVSNSKYEGVDLNKGTFTA PDSTKTTPKPPATGDAKDFP LALTPNDPGFNDLVGIAPGP RMNMASTNARYVRYLLIAFF (SEQ ID NO: 690) | TKSVPTFPTVPTDSRPSAAFVVSDAPGAYESPLL VFTCRRDQYLRETLRDIWNYIPTDCSVGCPLVIS QDGNDPAVRRVVREFTDEFATKNVPVIHWTHTS ALRGSTNGYQALAIHYGWALRRVFDGQTLSGSV HGAKHGTPQRVIILEEDLHVAPDFFDYFAATAPLL DHDSSLLAVSAFHDNGFAHNVRNASRILRSDFFP GLGWMMNRRLWVDELQSKWPGGYWDDWLRE PAQRQDRAILRPEISRTYHFGTEGGTSSNQFGS HLSKILLNRETVDWSKAADLEAQLRPEVYDPAY WAMVQASTLTYTIPDALEQAKKSNARLQYTTIEQ FKYLAHKLKLMADEKANVPRTAYKGIVETRPHGA DYFLFLTPPLAELQKEFDIPSPKR (SEQ ID NO: 691) |
| pTTv485 | GnTII targeting | MRFRIYKRKVLILTLVVAACG FVLWSSNGRQRKNEALAPPL LDAEPARGAGGRGGDHP (SEQ ID NO: 692) | SVSALDGDPASLTREVIRLAQDAEVELERQRGLL QQIGDALSSQRGRVPTAAPPAQPRVPVTPAPAVI PILVIACDRSTVRRCLDKLLHYRPSAELFPIIVSQD CGHEETAQAIASYGSAVTHIRQPDLSSIAVPPDH RKFQGYYKIARHYRWALGQVFRQFRFPAAVVVE DDLEVAPDFFEYFRATYPLLKADPSLWCVSAWN DNGKEQMVDASRPELLYRTDFFPGLGWLLLAEL WAELEPKWPKAFWDDWMRRPEQRQGRACIRP EISRTMTFGRKGVSHGQFFDQHLKFIKLNQQFV HFTQLDLSYLQREAYDRDFLARVYGAPQLQVEK VRTNDRKELGEVRVQYTGRDSFKAFAKALGVM DDLKSGVPRAGYRGIVTFQFRGRRVHLAPPPTW EGYDPSWN (SEQ ID NO: 693) |
| pTTv493 | no targeting | n/a | MTKSVPTFPTVPTDSRPSAAFVVSDAPGAYESP LLVFTCRRDQYLRETLRDIWNYIPTDCSVGCPLVI SQDGNDPAVRRVVREFTDEFATKNVPVIHWTHT SALRGSTNGYQALAIHYGWALRRVFDGQTLSGS VHGAKHGTPQRVIILEEDLHVAPDFFDYFAATAP LLDHDSSLLAVSAFHDNGFAHNVRNASRILRSDF FPGLGWMMNRRLWVDELQSKWPGGYWDDWL REPAQRQDRAILRPEISRTYHFGTEGGTSSNQF GSHLSKILLNRETVDWSKAADLEAQLRPEVYDPA |

TABLE 53-continued

| Vector | Notes | Targeting signal sequence | GnTI sequence |
|---|---|---|---|
| | | | YWAMVQASTLTYTIPDALEQAKKSNARLQYTTIE QFKYLAHKLKLMADEKANVPRTAYKGIVETRPH GADYFLFLTPPLAELQKEFDIPSPKR (SEQ ID NO: 694) |
| pTTv494 | GnTII targeting | MRFRIYKRKVLILTLVVAACG FVLWSSNGRQRKNEALAPPL LDAEPARGAGGRGGDHP (SEQ ID NO: 695) | TKSVPTFPTVPTDSRPSAAFVVSDAPGAYESPLL VFTCRRDQYLRETLRDIWNYIPTDCSVGCPLVIS QDGNDPAVRRVVREFTDEFATKNVPVIHWTHTS ALRGSTNGYQALAIHYGWALRRVFDGQTLSGSV HGAKHGTPQRVIILEEDLHVAPDFFDYFAATAPLL DHDSSLLAVSAFHDNGFAHNVRNASRILRSDFFP GLGWMMNRRLWVDELQSKWPGGYWDDWLRE PAQRQDRAILRPEISRTYHFGTEGGTSSNQFGS HLSKILLNRETVDWSKAADLEAQLRPEVYDPAY WAMVQASTLTYTIPDALEQAKKSNARLQYTTIEQ FKYLAHKLKLMADEKANVPRTAYKGIVETRPHGA DYFLFLTPPLAELQKEFDIPSPKR (SEQ ID NO: 696) |
| pTTv496 | Anp1 targeting | MMPRHHSSGFSNGYPRADT FEISPHVPAKSHAPSPQETQ EDSDSRRHSSCCHPRPRPL VRPAPICRLPHLARHLVWIR (SEQ ID NO: 697) | TKSVPTFPTVPTDSRPSAAFVVSDAPGAYESPLL VFTCRRDQYLRETLRDIWNYIPTDCSVGCPLVIS QDGNDPAVRRVVREFTDEFATKNVPVIHWTHTS ALRGSTNGYQALAIHYGWALRRVFDGQTLSGSV HGAKHGTPQRVIILEEDLHVAPDFFDYFAATAPLL DHDSSLLAVSAFHDNGFAHNVRNASRILRSDFFP GLGWMMNRRLWVDELQSKWPGGYWDDWLRE PAQRQDRAILRPEISRTYHFGTEGGTSSNQFGS HLSKILLNRETVDWSKAADLEAQLRPEVYDPAY WAMVQASTLTYTIPDALEQAKKSNARLQYTTIEQ FKYLAHKLKLMADEKANVPRTAYKGIVETRPHGA DYFLFLTPPLAELQKEFDIPSPKR (SEQ ID NO: 698) |
| pTTv497 | Sec12 targeting | MASSSKTPGEAPVRYVTAM RAKAPSRRPLVITLSIMVLIMA IIGQGVMEIYGVSKPILNAQKF VPSWHGTLRDPTHPPAAFNK EYL (SEQ ID NO: 699) | TKSVPTFPTVPTDSRPSAAFVVSDAPGAYESPLL VFTCRRDQYLRETLRDIWNYIPTDCSVGCPLVIS QDGNDPAVRRVVREFTDEFATKNVPVIHWTHTS ALRGSTNGYQALAIHYGWALRRVFDGQTLSGSV HGAKHGTPQRVIILEEDLHVAPDFFDYFAATAPLL DHDSSLLAVSAFHDNGFAHNVRNASRILRSDFFP GLGWMMNRRLWVDELQSKWPGGYWDDWLRE PAQRQDRAILRPEISRTYHFGTEGGTSSNQFGS HLSKILLNRETVDWSKAADLEAQLRPEVYDPAY WAMVQASTLTYTIPDALEQAKKSNARLQYTTIEQ FKYLAHKLKLMADEKANVPRTAYKGIVETRPHGA DYFLFLTPPLAELQKEFDIPSPKR (SEQ ID NO: 700) |

PmeI fragments of these constructs were used to transform protoplasts of MAB01 antibody producing strain TR222. Transformants were screened for correct integration by PCR, as above. Positive transformants were purified by single spore cultures, spore stocks were made and resulting new strains were cultured in shake flasks (Trmm, 4% Lac, 2% SGE, 100 mM Pipps pH 5.5). MAB01 antibody was purified from culture supernatant from day 5 samples and subjected for glycan analytics. Exact 3' integration site of pTTv485 (pgpdA-(Kre2)HuGnTI) could not be verified in PCR screen, however, the strain was included into the glycan analysis.

The results from glycan analyses of clones #1-9 (pTTv484; pgpdA-(Kre2)-PtGnTI), #28-3 and #28-6 (pTTv494; pgpdA-(GnTII)PtGnTI), #17-6 and #17-7 (pTTv497; pgpdA-(Sec12)PtGnTI), #41-7 and #41-8 (pTTv493; pgpdA-PtGnTI), #10-5, #1-4 and #1-3 (pTTv496; pgpdA-(Anp1)PtGnTI) are shown in Table 54. The Kre2 targeting signal for PtGnTI produced 91.5% of GnTI product, GnMan5. Human GnTII targeted PtGnTI resulted over 85% of GnMan5 whereas human GnTII targeted human GnTI resulted about 45% of GnMan5.

TABLE 54

Relative proportions of the predominant neutral N-glycans from purified MAB01 antibody from targeting series of GnTI from *P. tricornutum* and human GnTII targeted with human GnTI.

| | | | pTTv484 | pTTv494 | | pTTv497 | | pTTv493 | | pTTv496 | | | pTTv485 |
|---|---|---|---|---|---|---|---|---|---|---|---|---|---|
| Composition | Short | m\z | #1-9 % | #28-3 % | #28-6 % | #17-6 % | #17-7 % | #41-7 % | #41-8 % | #10-5 % | #1-4 % | #1-3 % | #12-2 % |
| Man4 | H4N2 | 1095.37 | 0.0 | 0.0 | 0.0 | 0.0 | 0.0 | 1.4 | 1.4 | 1.0 | 1.2 | 0.0 | 0.8 |
| Man5 | H5N2 | 1257.42 | 4.6 | 9.4 | 8.3 | 89.4 | 89.1 | 90.9 | 92.3 | 92.5 | 91.3 | 88.7 | 47.6 |
| GnMan4 | H4N3 | 1298.45 | 0.7 | 0.9 | 0.7 | 0.0 | 0.0 | 0.0 | 0.0 | 0.0 | 0.0 | 0.0 | 0.4 |

TABLE 54-continued

Relative proportions of the predominant neutral N-glycans from purified MAB01 antibody from targeting series of GnTI from *P. tricornutum* and human GnTII targeted with human GnTI.

| | | | pTTv484 | pTTv494 | | pTTv497 | | pTTv493 | | | pTTv496 | | pTTv485 |
|---|---|---|---|---|---|---|---|---|---|---|---|---|---|
| | | | #1-9 | #28-3 | #28-6 | #17-6 | #17-7 | #41-7 | #41-8 | #10-5 | #1-4 | #1-3 | #12-2 |
| Composition | Short | m\z | % | % | % | % | % | % | % | % | % | % | % |
| Man6 | H6N2 | 1419.48 | 0.9 | 1.1 | 1.0 | 0.0 | 0.0 | 1.8 | 1.4 | 1.5 | 1.9 | 3.2 | 1.0 |
| GnMan5 | H5N3 | 1460.50 | 91.5 | 86.2 | 86.9 | 10.6 | 10.9 | 0.4 | 0.0 | 0.0 | 0.0 | 0.0 | 45.2 |
| Man7 | H7N2 | 1581.53 | 1.3 | 1.5 | 2.0 | 0.0 | 0.0 | 3.3 | 2.6 | 2.9 | 3.4 | 4.9 | 2.8 |
| Man8 | H8N2 | 1743.58 | 1.0 | 0.9 | 1.1 | 0.0 | 0.0 | 1.5 | 1.8 | 1.5 | 1.7 | 3.2 | 1.5 |
| Man9 | H9N2 | 1905.63 | 0.0 | 0.0 | 0.0 | 0.0 | 0.0 | 0.4 | 0.5 | 0.6 | 0.4 | 0.0 | 0.4 |

Site occupancy analysis. 30 µg of MAB01 antibody was digested with 13.4 U of FabRICATOR (Genovis), +37° C., 60 min, producing F(ab')2 fragment and two Fc fragments. Digested samples were purified using Poros R1 filter plate (Glyken corp.) and the Fc fragments were analysed using MALDI-TOF MS. The results are shown in Table 55. The site occupancy varies between 95% and 100%.

TABLE 55

Site occupancy analysis of MAB01 antibody from the above targeting series. The values have been calculated from area and intensity from single charged signals.

| | pTTv484 | pTTv494 | | pTTv497 | | pTTv493 | | | pTTv496 | | pTTv485 |
|---|---|---|---|---|---|---|---|---|---|---|---|
| | #1-9 | #28-3 | #28-6 | #17-6 | #17-7 | #41-7 | #41-8 | #10-5 | #1-4 | #1-3 | #12-2 |
| Glycosylated | 96.3 | 97.0 | 95.6 | 96.2 | 97.6 | 98.1 | 98.4 | 99.5 | 99.1 | 98.3 | 99.5 |
| Non-glycosylated | 3.7 | 3.0 | 4.4 | 3.8 | 2.4 | 1.9 | 1.6 | 0.5 | 0.9 | 1.7 | 0.5 |

Example 11

Generation of M1031 and M1033

This example describes the generation of *T. reesei* strain with the following characteristics:
- it is deficient for pep1, tsp1, slp1, gap1, gap2, pep4, pep3 and alg3 protease genes,
- it comprises GnTI, GnTII, GalT, GMD, FX and FUT8 genes.

The resulting strains M1031/1033 produce MAB01 with only 2.5% FG2 glycoform but 69.3% Hex6 glycoform.

Generation of strains producing MAB01 and galactosylated and fucosylated glycoforms (M1031 and M1033) are described in Example 11 of WO2013/174927.

Fermentation and glycan analysis of M1031 and M1033. Strains M1031 (#41-1) and M1033 (#48-2) were fermented in 4% WSG, 2% glucose, 4% cellobiose and 6% lactose and samples were collected at days 3-6. The N-glycan analysis was performed as described above. The results are shown in Table 56.

TABLE 56

Relative proportions of the predominant neutral N-glycans from purified MAB01 antibody from strains M1031 and M1033 fermented in WSG medium.

| | | | M1031 | | | | M1033 | | | |
|---|---|---|---|---|---|---|---|---|---|---|
| Composition | Alternative name | m\z | d3 % | d4 % | d5 % | d6 % | d3 % | d4 % | d5 % | d6 % |
| Hex3HexNAc2 | Man3 | 933.31 | 2.8 | 2.7 | 4.1 | 7.2 | 5.4 | 3.6 | 3.9 | 4.4 |
| Hex4HexNAc2 | Man4 | 1095.37 | 3.4 | 3.7 | 3.6 | 5.7 | 7.2 | 5.6 | 6.5 | 6.7 |
| Hex5HexNAc2 | Man5 | 1257.42 | 3.7 | 3.5 | 2.6 | 4.2 | 8.1 | 6.7 | 7.5 | 6.8 |
| Hex3HexNAc4 | G0 | 1339.48 | 1.6 | 2.1 | 2.0 | 3.7 | 0.0 | 1.7 | 1.4 | 1.4 |
| Hex6HexNAc2 | Hex6 | 1419.48 | 71.9 | 68.9 | 69.3 | 63.4 | 63.6 | 64.5 | 63.6 | 65.5 |
| Hex3HexNAc4dHex | FG0 | 1485.53 | 0.9 | 1.9 | 1.5 | 0.0 | 0.0 | 0.9 | 0.7 | 0.8 |
| Hex4HexNAc4 | G1 | 1501.53 | 1.9 | 2.2 | 2.1 | 5.5 | 0.0 | 0.9 | 1.2 | 1.2 |
| Hex7HexNAc2 | Hex7 | 1581.53 | 1.5 | 1.7 | 0.0 | 0.0 | 2.3 | 1.7 | 1.3 | 1.3 |
| Hex4HexNAc4dHex | FG1 | 1647.590 | 0.7 | 0.0 | 1.6 | 0.0 | 0.0 | 0.0 | 0.5 | 0.0 |
| Hex5HexNAc4 | G2 | 1663.580 | 2.4 | 3.2 | 4.0 | 3.2 | 3.0 | 3.8 | 4.0 | 4.1 |
| Hex8HexNAc2 | Hex8 | 1743.580 | 0.0 | 0.0 | 0.0 | 0.0 | 0.0 | 0.0 | 0.3 | 0.0 |
| Hex5HexNAc4dHex | FG2 | 1809.640 | 1.4 | 2.5 | 2.4 | 2.1 | 1.8 | 1.6 | 1.7 | 1.4 |

Generation of the strain M1039. Strains M1039 (which was generated by transforming a construct with human cDNA1 promoter followed by human GnTII with alg3 flanks into the strain M905 (from WO2013/174927) was fermented in 4% WSG, 2% glucose, 4% cellobiose and 6% lactose and samples were collected at days 3-6. The N-glycan analysis was performed as described above. The results are shown in Table 57.

TABLE 57

Relative proportions of the predominant neutral N-glycans from purified MAB01 antibody from strain M1039 fermented in WSG medium.

| | | | M1039 | | | |
|---|---|---|---|---|---|---|
| Composition | Short | m\z | d3 % | d4 % | d5 % | d6 % |
| Hex3HexNAc2 | Man3 | 933.31 | 5.6 | 10.6 | 12.1 | 13.9 |
| Hex4HexNAc2 | Man4 | 1095.37 | 4.1 | 4.5 | 5.7 | 4.8 |
| Hex5HexNAc2 | Man5 | 1257.42 | 4.9 | 4.6 | 4.3 | 3.6 |
| Hex3HexNAc4 | G0 | 1339.48 | 19.8 | 18.0 | 14.3 | 13.4 |
| Hex6HexNAc2 | Hex6 | 1419.48 | 46.7 | 47.8 | 50.0 | 49.7 |
| Hex3HexNAc4dHex | FG0 | 1485.53 | 12.3 | 8.2 | 7.9 | 8.8 |
| Hex7HexNAc2 | Hex7 | 1581.53 | 2.2 | 1.5 | 1.5 | 1.4 |

Generation and shake flask culture of strains M1223-M1226. Strains M1223-M1226 were constructed by transforming the split marker vectors pTTv473+pTTv482/483 to strain M1061. Vector combinations and strain details are presented in table below.

| Strain | Vectors transformed | Background strain | Locus |
|---|---|---|---|
| M1223 | pTTv473 + pTTv482 | M1061 (pyr- of M950) | pep4 |
| M1224 | pTTv473 + pTTv482 | M1061 (pyr- of M950) | pep4 |
| M1225 | pTTv473 + pTTv483 | M1061 (pyr- of M950) | pep4 |
| M1226 | pTTv473 + pTTv483 | M1061 (pyr- of M950) | pep4 |

Vectors were constructed using routine recombination cloning methods. Details of the fragments used for vectors are presented in table below.

| Plasmid | Fragments and origin |
|---|---|
| pTTv473 | 1) SwaI linearized pTTv471 (backbone)<br>2) PCR product from pTTv412 template, primers T1747 and T1746 (pGPDA-PtGnTI-tCBHI) |
| pTTv482 | 1) SgfI linearized pTTv474 (backbone)<br>2) AscI-SgfI cut fragment containing Xyn1 terminator<br>3) PCR product from pTTg214, primers T1775 and T1776 (pCDNA-TcGlsIIalpha)<br>4) Overlapping oligos T1754 and T1755 |
| pTTv483 | Like pTTv482, except pTTv475 instead of pTTv474 as the backbone |
| pTTv471 | 1) SwaI linearized pTTv224 (backbone)<br>2) PCR product from pTTv201 template, primers T1738 and T1741 |
| pTTv474 | 1) SgfI linearized pTTv225 (backbone)<br>2) NotI-HindIII cut fragment from pTTv94 (cloning vector containing notI-pGPDA-apaI-synthetic sequence encoding CeFut8 amino acids 1-559-ttrpC-hindIII)<br>3) Overlapping oligos T1742 and T1743<br>4) Overlapping oligos T1748 and T1749 |
| pTTv475 | 1) SgfI linearized pTTv225 (backbone)<br>2) NotI-ApaI cut fragment from pTTv94 (cloning vector containing notI-pGPDA-apaI-synthetic sequence encoding CeFut8 amino acids 1-559-ttrpC-hindIII)<br>3) PCR product from pTTv274, primers T1750 and T1751 (huGnTII)<br>4) ApaI-HindIII cut fragment from pTTv94 (cloning vector containing notI-pGPDA-apaI-synthetic sequence encoding CeFut8 amino acids 1-559-ttrpC-hindIII)<br>5) Overlapping oligos T1742 and T1753<br>6) Overlapping oligos T1754 and T1755 |

| Primer | Sequence |
|---|---|
| T1747 | AAGTTCCCTTCCTCTGGCAGCAATCGAACCATCCCATTCACCTTGTATCTCTACACACAGG CTC (SEQ ID NO: 701) |
| T1746 | GTCCATCATTCCACGTCCTTCAGACCGGCCGGCCGAATTCTCATCGTCTTGACAGCAATG C (SEQ ID NO: 702) |
| T1775 | CCTCGTGTACTGTGTAAGCGCCCACTCCACATCTCCACTCGCGATCGCGGTCTGAAGGAC GTGGAATGA (SEQ ID NO: 703) |

-continued

| | |
|---|---|
| T1776 | CTCAAACCCCTCATCCACTCCAAGTCAACATCAACAGAACTCACTTCTTGAGGACGATGAC C (SEQ ID NO: 704) |
| T1753 | AACAAATATAGGCACACATTGGCACTAATACGAGCACCAAGCGATCGCGAGTGGAGATGT GGAGTGGGCGCTTACACAGTACACGAGG (SEQ ID NO: 705) |
| T1754 | CCTCCTATGCTTTTACAAGCTGCTCCTCTATCCGCCCCCAGCGATCGCAGGTAGACGCTT TGCGAGTGTGTGTGTATCTAAGAAGTGC (SEQ ID NO: 706) |
| T1755 | GCACTTCTTAGATACACACACACTCGCAAAGCGTCTACCTGCGATCGCTGGGGCGGATA GAGGAGCAGCTTGTAAAAGCATAGGAGG (SEQ ID NO: 707) |
| T1738 | TCCCTTCCTCTGGCAGCAATCGAACCATCCCATTCAATTTAAATGAATTCGGCCGGCCGGT CTGAAGGACGTGGAATGATGGACTTAATGAC (SEQ ID NO: 708) |
| T1741 | TTCTTCTTATTGATTTGAGCCTGTGTGTAGAGATACAAGGCCGGCCGAGTGGAGATGTGG AGTGGGCGCTTACACAGTAC (SEQ ID NO: 709) |
| T1742 | ATGATGCCTTTGCAGAAATGGCTTGCTCGCTGACTGATACCCTTGTATCTCTACACACAGG CTCAAATCAATAAGAAGAA (SEQ ID NO: 710) |
| T1743 | TTCTTCTTATTGATTTGAGCCTGTGTGTAGAGATACAAGGGTATCAGTCAGCGAGCAAGCC ATTTCTGCAAAGGCATCAT (SEQ ID NO: 711) |
| T1748 | CCTCGTGTACTGTGTAAGCGCCCACTCCACATCTCCACTCGCGATCGCAGGTAGACGCTT TGCGAGTGTGTGTGTATCTAAGAAGTGC (SEQ ID NO: 712) |
| T1749 | GCACTTCTTAGATACACACACACTCGCAAAGCGTCTACCTGCGATCGCGAGTGGAGATGT GGAGTGGGCGCTTACACAGTACACGAGG (SEQ ID NO: 713) |

Strains M1223-M1226 were cultured in shake flasks in TrMM, 4% lactose, 2% spent grain extract, 100 mM PIPPS, pH 5.5, for 5 days. The N-glycan analysis was performed as described above. The results are shown in Table 58.

TABLE 58

Relative proportions of the predominant neutral N-glycans from purified MAB01 antibody from strain GM1223-GM1226 and parent strain M950 cultured in shake flasks for 5 days in SGE medium.

| Composition | Short | m\z | GM1223 % | GM1224 % | GM1225 % | GM1226 % | M950 % |
|---|---|---|---|---|---|---|---|
| Hex3HexNAc2 | Man3 | 933.31 | 8.4 | 10.8 | 22.5 | 19.4 | 25.5 |
| Hex4HexNAc2 | Man4 | 1095.37 | 8.9 | 9.4 | 15.7 | 7.0 | 3.1 |
| Hex3HexNAc3 | GnMan3 | 1136.40 | 15.1 | 17.5 | 13.8 | 0.0 | 3.3 |
| Hex5HexNAc2 | Man5 | 1257.42 | 7.5 | 8.3 | 13.8 | 16.7 | 2.8 |
| Hex3HexNAc3dHex | FGnMan3 | 1282.45 | 20.4 | 11.9 | 7.0 | 0.0 | 0.0 |
| Hex3HexNAc4 | G0 | 1339.48 | 2.2 | 3.7 | 7.0 | 10.6 | 26.2 |
| Hex6HexNAc2 | Hex6 | 1419.48 | 27.8 | 27.2 | 20.2 | 10.4 | 38.0 |
| Hex3HexNAc4dHex | FG0 | 1485.53 | 1.2 | 2.5 | 0.0 | 25.9 | 0.0 |
| Hex7HexNAc2 | Hex7 | 1581.53 | 0.0 | 0.5 | 0.0 | 2.8 | 0.4 |

Example 12

Generation of *T. reesei* Expressing *L. major* STT3 and Cloning of *L. infantum* STT3

The *Leishmania major* oligosaccharyl transferase 4D (old GenBank No. XP_843223.1, new XP_003722509.1, SEQ ID NO:463) coding sequence was codon optimized for *Trichoderma reesei* expression. The optimized coding sequence was synthesized along with cDNA1 promoter and TrpC terminator flanking sequence. The *Leishmania major* STT3 gene was excised from the optimized cloning vector using PacI restriction enzyme digestion. The expression entry vector was also digested with PacI and dephosphorylated with calf alkaline phosphatase. The STT3 gene and the digested vector were separated with agarose gel electrophoresis and correct fragments were isolated from the gel with a gel extraction kit (Qiagen) according to manufacturer's protocol. The purified *Leishmania major* STT3 gene was ligated into the expression vector with T4 DNA ligase. The ligation reaction was transformed into chemically competent DH5α *E. coli* and grown on ampicillin (100 µg/ml) selection plates. Miniprep plasmid preparations were made from several colonies. The presence of the *Leishmania major* STT3 gene insert was checked by digesting the prepared plasmids with PacI digestion and several positive clones were sequenced to verify the gene orientation. One correctly orientated clone was chosen to be the final vector pTTv201.

The expression cassette contained the constitutive cDNA1 promoter from *Trichoderma reesei* to drive expression of *Leishmania major* STT3. The terminator sequence included in the cassette was the TrpC terminator from *Aspergillus niger*. The expression cassette was targeted into the xylanase 1 locus (xyn1, tre74223) using the xylanase 1 sequence from the 5' and 3' flanks of the gene (see above sequences). These sequences were included in the cassette to allow the cassette to integrate into the xyn1 locus via homologous recombination. The cassette contained a pyr4 loopout marker for selection. The pyr4 gene encodes the orotidine-5'-monophosphate (OMP) decarboxylase of *T. reesei* (Smith, J. L., et al., 1991, Current Genetics 19:27-33) and is needed for uridine synthesis. Strains deficient for OMP decarboxylase activity are unable to grow on minimal medium without uridine supplementation (i.e. are uridine auxotrophs).

Figure 15:
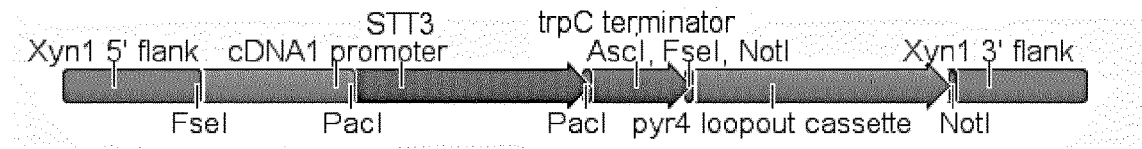
FIG. 15. Schematic expression cassette design for *Leishmania major* STT3 targeted to the xylanase 1 locus.
Figure 16:
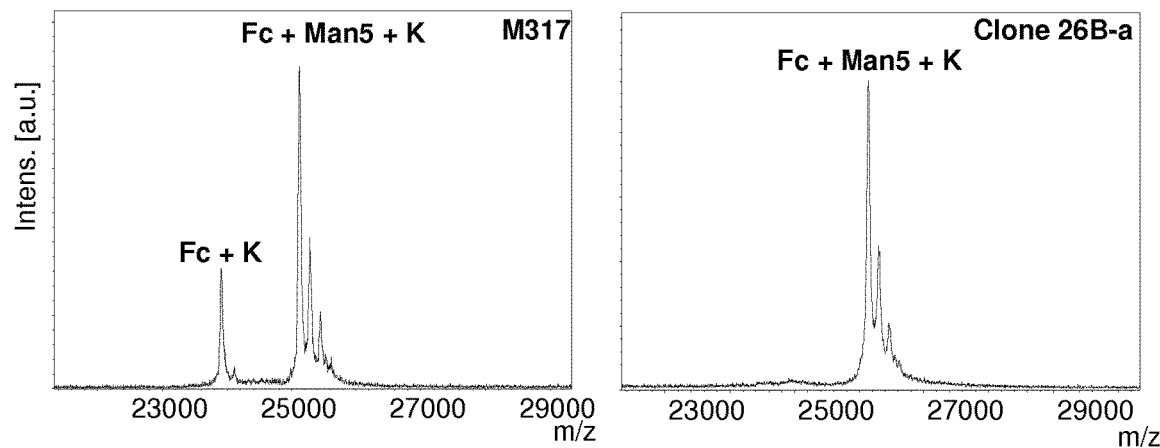
FIG. 16. Example spectra of parental strain M317 (pyr4− of M304) and *L. major* STT3 clone 26B-a (M421). K means lysine.

To prepare the vector for transformation, the vector was cut with PmeI to release the expression cassette (FIG. 15). The digest was separated with agarose gel electrophoresis and the correct fragment was isolated from the gel with a gel extraction kit (Qiagen) according to manufacturer's protocol. The purified expression cassette DNA (5 µg) was then transformed into protoplasts of the *Trichoderma reesei* strain M317 (M317 has been described in WO2013/102674; M317 is pyr4- of M304 and it comprises MAB01 light chain fused to *T. reesei* truncated CBH1 carrier with NVISKR Kex2 cleavage sequence, MAB01 heavy chain fused to *T. reesei* truncated CBH1 carrier with AXE1 [DGETVVKR] Kex2 cleavage sequence, Δpep1Δtsp1Δslp1, and overexpression of *T. reesei* KEX2). Preparation of protoplasts and transformation were carried out according to methods in Penttilä et al. (1987, Gene 61:155-164) and Gruber et al (1990, Curr. Genet. 18:71-76) for pyr4 selection. The transformed protoplasts were plated onto *Trichoderma* minimal media (TrMM) plates.

Transformants were then streaked onto TrMM plates with 0.1% TritonX-100. Transformants growing fast as selective streaks were screened by PCR using the primers listed in Table 59. DNA from mycelia was purified and analyzed by PCR to look at the integration of the 5' and 3' flanks of cassette and the existence of the xylanase 1 ORF. The cassette was targeted into the xylanase 1 locus; therefore the open reading frame was not present in the positively integrated transformants. To screen for 5' integration, sequence outside of the 5' integration flank was used to create a forward primer that would amplify genomic DNA flanking xyn1 and the reverse primer was made from sequence in the cDNA promoter of the cassette. To check for proper integration of the cassette in the 3' flank, a forward primer was made from sequence outside of the 3' integration flank that would amplify genomic DNA flanking xyn1 and the reverse primer was made from sequence in the pyr4 marker. Thus, one primer would amply sequence from genomic DNA outside of the cassette and the other would amply sequence from DNA in the cassette. The primer sequences are listed in Table 59. Four final strains showing proper integration and a deletion of xyn1 orf were called M420-M423.

Shake flask cultures were conducted for four of the STT3 producing strains (M420-M423) to evaluate growth characteristics and to provide samples for glycosylation site occupancy analysis. The shake flask cultures were done in TrMM, 40 g/l lactose, 20 g/l spent grain extract, 9 g/l casamino acids, 100 mM PIPPS, pH 5.5. *L. major* STT3 expression did not affect growth negatively when compared to the parental strain M304 (Tables 60 and 61). The cell dry weight for the STT3 expressing transformants appeared to be slightly higher compared to the parent strain M304.

TABLE 59

List of primers used for PCR screening of STT3 transformants.

| 5' flank screening primers: | 1205 bp product |
| --- | --- |
| T403_Xyn1_5'flank_fwd | CCGCGTTGAACGGCTTCCCA (SEQ ID NO: 714) |
| T140_cDNA1promoter_rev | TAACTTGTACGCTCTCAGTTCGAG (SEQ ID NO: 715) |
| 3' flank screening primers: | 1697 bp product |
| T404_Xyn1_3'flank_fwd | GCGACGGCGACCCATTAGCA (SEQ ID NO: 716) |
| T028_Pyr4_flank_rev | CATCCTCAAGGCCTCAGAC (SEQ ID NO: 717) |
| xylanase 1 orf primers: | 589 bp product |
| T405_Xyn1_orf_screen_fwd | TGCGCTCTCACCAGCATCGC (SEQ ID NO: 718) |
| T406_Xyn1_orf_screen_rev | GTCCTGGGCGAGTTCCGCAC (SEQ ID NO: 719) |

TABLE 60

Cell dry weight from large shake flask cultures.

| | Cell dry weight (g/L) | | |
| --- | --- | --- | --- |
| | day 3 | day 5 | day 7 |
| M304 | 2.3 | 3.3 | 4.3 |
| M420 | 3.7 | 4.3 | 5.4 |
| M421 | 3.7 | 4.6 | 6.3 |
| M422 | 3.8 | 4.5 | 5.4 |
| M423 | 3.7 | 4.6 | 5.7 |

TABLE 61 pH values from large shake flask cultures

| | pH values | | |
| --- | --- | --- | --- |
| | day 3 | day 5 | day 7 |
| M304 | 5.6 | 6.1 | 6.2 |
| M420 | 6.1 | 6.1 | 6.1 |
| M421 | 6.0 | 5.9 | 6.0 |
| M422 | 6.1 | 6.1 | 6.2 |
| M423 | 6.1 | 6.1 | 6.1 |

Site occupancy analysis. Four transformants [pTTv201; 17A-a (M420), 26B-a (M421), 65B-a (M422) and 97A-a (M423)] and their parental strain (M317) were cultivated in shake flasks and samples at day 5 and 7 time points were collected. MAB01 antibody was purified from culture supernatants using Protein G HP MultiTrap 96-well plate (GE Healthcare) according to manufacturer's instructions. The antibody was eluted with 0.1 M citrate buffer, pH 2.6 and neutralized with 2 M Tris, pH 9. The concentration was determined via UV absorbance in spectrophotometer against MAB01 standard curve. 10 µg of antibody was digested with 13.4 U of FabRICATOR (Genovis), +37° C., 60 min, producing F(ab')2 fragment and two Fc fragments. Digested samples were purified using Poros R1 filter plate (Glyken corp.) and the Fc fragments were analysed using MALDI-TOF MS (FIG. 2).

The overexpression of STT3 from *Leishmania major* enhanced the site coverage compared to the parental strain. The best clone was re-cultivated in three parallel shake flasks each and the analysis results were comparable to the first analysis. Compared to parental strain the signals Fc and Fc+K are practically absent in STT3 clones.The difference in site occupancy between parental strain and all clones of STT3 from *L. major* was significant (Fig. A). Because the signals coming from Fc or Fc+K were practically absent, the N-glycan site occupancy of MAB01 in these shake flask cultivations was 100% (Table 62).

TABLE 62

Site occupancy analysis of parental strain M317 and four transformants of STT3 from *L. major*. The averages have been calculated from area and intensity from single and double charged signals from three parallel samples.

| Glycosylation state | M317 Average % | 17A-a Average % | 26B-a Average % | 65B-a Average % | 97A-a Average % |
|---|---|---|---|---|---|
| Non-glycosylated | 13.0 | 0.0 | 0.0 | 0.0 | 0.0 |
| Glycosylated | 87.0 | 100.0 | 100.0 | 100.0 | 100.0 |

Fermenter cultivations. Three STT3 (*L. major*) clones (M420, M421 and M422) as well as parental strain M304 were cultivated in fermenter. Samples at day 3, 4, 5, 6 and 7 time points were collected and the site occupancy analysis was performed to purified antibody. STT3 overexpression strains and the respective control strain (M304) were grown in batch fermentations for 7 days, in media containing 2% yeast extract, 4% cellulose, 4% cellobiose, 2% sorbose, 5 g/L KH2PO4, and 5 g/L (NH4)2504. Culture pH was controlled at pH 5.5 (adjusted with $NH_3OH$). The temperature was shifted from 28° C. to 22° C. at 48 hours elapsed process time. Fermentations were carried out in 4 parallel 2 L glass vessel reactors with a culture volume of 1 L. Culture supernatant samples were taken during the course of the runs and stored at −20° C. MABO1 antibody was purified and digested with FabRICATOR as described above. The antibody titers are shown in Table 63.

Results. The site occupancy in parental strain M304 was less than 60% but in all analyzed STT3 clones the site occupancy had increased up to 98% (Table 64).

TABLE 63

MABO1 antibody titers of the LmSTT3 strains M420, M421 and M422 and their parental strain M304.

| | Titer g/l | | | | |
|---|---|---|---|---|---|
| Strain | d3 | d4 | d5 | d6 | d7 |
| M304 | 0.225 | 0.507 | 0.981 | 1.52 | 1.7 |
| M420 | 0.758 | 1.21 | 1.55 | 1.71 | 1.69 |
| M421 | 0.76 | 1.24 | 1.54 | 1.67 | 1.6 |
| M422 | 0.65 | 1.07 | 1.43 | 1.56 | 1.54 |

TABLE 64

The N-glycosylation site occupancies of MABO1 antibody of the LmSTT3 strains M420, M421 and M422 and their parental strain M304.

| | Site occupancy % | | | | |
|---|---|---|---|---|---|
| Strain | d3 | d4 | d5 | d6 | d7 |
| M304 | 48.0 | 47.7 | 47.7 | 46.3 | 55.4 |
| M420 | 97.8 | 97.5 | 96.9 | 94.3 | 94.6 |
| M421 | 96.1 | 90.8 | 91.5 | 89.7 | 95.6 |
| M422 | 94.4 | 88.5 | 80.9 | 83.6 | 75.2 |

In conclusion, overexpression of the STT3D gene from *L. major* increased the N-glycosylation site occupancy from 46%-87% in the parental strain to 98%-100% in transformants having *Leishmania* STT3 under shake flask or fermentation culture conditions. The overexpression of the STT3D gene from *L. major* significantly increased the N-glycosylation site occupancy in strains producing an antibody as a heterologous protein. The antibody titers did not vary significantly between transformants having STT3 and parental strain.

Cloning of *L. infantum* STT3 and effect on site coverage. The coding sequence of the *Leishmania infantum* oligosaccharyl transferase (STT3; amino acid sequence *L. infantum* SEQ ID NO: 104) wase codon optimized for *Trichoderma reesei* expression (codon optimized *L. infantum* nucleic acid SEQ ID NO: 108). The optimized coding sequence was synthesized along with *T. reesei* cbh1 terminator flanking sequence (SEQ ID NO: 266). Plasmid containing the STT3 gene under the constitutive cDNA1 promoter, with cbh1 terminator, pyr4 loopout marker and alg3 flanking regions (SEQ ID NO: 267 and SEQ ID NO: 268) was cloned by yeast homologous recombination as described in WO2012/069593. NotI fragment of plasmid pTTv38 was used as vector backbone. This vector contains alg3 (tre104121) 5' and 3' flanks of the gene to allow the expression cassette to integrate into the alg3 locus via homologous recombination in *T. reesei* and the plasmid has been described in WO2012/069593. The STT3 gene was excised from the cloning vectors using SfiI restriction enzyme digestion. The cdnal promoter and cbh1 terminator fragments were created by PCR, using plasmids pTTv163 and pTTv166 as templates, respectively. The pyr4 loopout marker was extracted from plasmid pTTv142 by NotI digestion (the plasmid pTTv142 having a human GNT2 catalytic domain fused with *T. reesei* MNT1/KRE2 targeting peptide has been described in WO2012/069593). The pyr4 gene encodes the orotidine-5'-monophosphate (OMP) decarboxylase of *T. reesei* (Smith, J. L., et al., 1991, Current Genetics 19:27-33) and is needed for uridine synthesis. Strains deficient for OMP decarboxylase activity are unable to grow on minimal medium without uridine supplementation (i.e. are uridine auxotrophs). The primers used for cloning are listed in Table 65. The digested fragments and PCR products were separated with agarose gel electrophoresis and correct fragments were isolated from the gel with a gel extraction kit (Qiagen) according to manufacturer's protocol. The plasmids were constructed using the yeast homologous recombination method, using overlapping oligonucleotides for the recombination of the gap between the pyr4 marker and alg3 3' flank as described in WO2012/069593. The plasmid DNA was rescued from yeast and transformed into electrocompetent TOP10 *E. coli* that were grown on ampicillin (100 μg/ml) selection plates. Miniprep plasmid preparations were made from several colonies. The presence of the *Leishmania infantum* STT3 genes was confirmed by digesting the prepared plasmids with BglII-KpnI. Positive clones were sequenced to verify the plasmid sequence. A correct clone of *Leishmania infantum* was chosen to be the pTTv322 vector. The primers used for sequencing the vector are listed in Table 66.

was not present in the positively integrated transformants, purified to single cell clones. To screen for 5' integration, sequence outside of the 5' integration flank was used to create a forward primer that would amplify genomic DNA flanking alg3 and the reverse primer was made from

TABLE 65

List of primers used for cloning vector pTTv322.

| Fragment | Primer | Primer sequence |
|---|---|---|
| cDNA1 promoter, pTTv322 | T1177_pTTv321_1 | AGATTTCAGTCTCTCACCACTCACCTGAGTTGCCTCTCTCG GTCTGAAGGACGTGGAATGATG (SEQ ID NO: 269) |
|  | T1183_pTTv322_1 | CAGAGCCGCTATCGCCGAGGAGGTTGCCCTTCTTGCCCA TGTTGAGAGAAGTTGTTGGATTGATCA (SEQ ID NO: 270) |
| cbh1 terminator | T1179_pTTv321_3 | AGCTCCGTGGCGAAAGCCTGA (SEQ ID NO: 271) |
|  | T1180_pTTv321_4 | CAGCCGCAGCCTCAGCCTCTCTCAGCCTCATCAGCCGCG GCCGCCAACTTTGCGTCCCTTGTGACG (SEQ ID NO: 272) |
| pyr4-alg3 3' flank overlapping oligos | T1181_pTTv321_5 | GCAACGAGAGCAGAGCAGCAGTAGTCGATGCTAGGCGGC CGCGGGCAGTATGCCGGATGGCTGGCTTATACAGGCA (SEQ ID NO: 273) |
|  | T1182_pTTv321_6 | TGCCTGTATAAGCCAGCCATCCGGCATACTGCCCGCGGC CGCCTAGCATCGACTACTGCTGCTCTGCTCTCGTTGC (SEQ ID NO: 274) |

TABLE 66

List of primers used for sequencing vector pTTv322.

| Primer | Sequence |
|---|---|
| T027_Pyr4_orf_start_rev | TGCGTCGCCGTCTCGCTCCT (SEQ ID NO: 275) |
| T061_pyr4_orf_screen_2F | TTAGGCGACCTCTTTTTCCA (SEQ ID NO: 276) |
| T143_cDNA1promoter_seqF3 | CGAGGAAGTCTCGTGAGGAT (SEQ ID NO: 277) |
| T410_alg3_5-flank_F | CAGCTAAACCGACGGGCCA (SEQ ID NO: 278) |
| T1153_cbh1_term_start_rev | GACCGTATATTTGAAAAGGG (SEQ ID NO: 279) |

To prepare the vector for transformation, the vector was cut with PmeI to release the expression cassettes. The fragments were separated with agarose gel electrophoresis and the correct fragment was isolated from the gel with a gel extraction kit (Qiagen) according to manufacturer's protocol. The purified expression cassette DNA was then transformed into protoplasts of the *Trichoderma reesei* M317. Preparation of protoplasts and transformation were carried out essentially according to methods in Penttila et al. (1987, Gene 61:155-164) and Gruber et al (1990, Curr. Genet. 18:71-76) for pyr4 selection. The transformed protoplasts were plated onto *Trichoderma* minimal media (TrMM) plates containing sorbitol.

Transformants were then streaked onto TrMM plates with 0.1% TritonX-100. Transformants growing fast as selective streaks were screened by PCR using the primers listed in Table 67. DNA from mycelia was purified and analyzed by PCR to look at the integration of the 5' and 3' flanks of cassette and the existence of the alg3 ORF. The cassette was targeted into the alg3 locus; therefore the open reading frame sequence in the cDNA1 promoter of the cassette. To check for proper integration of the cassette in the 3' flank, a reverse primer was made from sequence outside of the 3' integration flank that would amplify genomic DNA flanking alg3 and the forward primer was made from sequence in the pyr4 marker. Thus, one primer would amplify sequence from genomic DNA outside of the cassette and the other would amplify sequence from DNA in the cassette.

TABLE 67

List of primers used for PCR screening of *T. reesei* transformants.

| 5' flank screening primers: | 1165 bp product |
|---|---|
| T066_104121_5int | GATGTTGCGCCTGGGTTGAC (SEQ ID NO: 280) |
| T140_cDNA1promoter_seqR1 | TAACTTGTACGCTCTCAGTTCGA (SEQ ID NO: 281) |
| 3' flank screening primers: | 1469 bp product |
| T026_Pyr4_orf_5rev2 | CCATGAGCTTGAACAGGTAA (SEQ ID NO: 282) |
| T068_104121_3int | GATTGTCATGGTGTACGTGA (SEQ ID NO: 283) |
| alg3 ORF primers: | 689 bp product |
| T767_alg3_del_F | CAAGATGGAGGGCGGCACAG (SEQ ID NO: 284) |
| T768_alg3_del_R | GCCAGTAGCGTGATAGAGAAGC (SEQ ID NO: 285) |
| alg3 ORF primers: | 1491 bp product |
| T069_104121_5orf_pcr | GCGTCACTCATCAAAACTGC (SEQ ID NO: 286) |

TABLE 67-continued

List of primers used for PCR screening of
T. reesei transformants.

| T070_104121_3orf_pcr | CTTCGGCTTCGATGTTTCA (SEQ ID NO: 287) |
|---|---|

Final strains each showing proper integration and a deletion of alg3 ORF were grown in large shake flasks in TrMM medium supplemented with 40 g/l lactose, 20 g/l spent grain extract, 9 g/l casamino acids and 100 mM PIPPS, pH 5.5. Three out of four Leishmania infantum pTTv322 clones grew somewhat better than the parental strain.

TABLE 68

Cell dry weight measurements (in g/L) of the parental strains M304 and STT3 expressing strains.

| Strain | 3 days | 5 days | 7 days |
|---|---|---|---|
| M304 | 3.06 | 3.34 | 4.08 |
| pTTv322#60-2 | 3.02 | 3.42 | 3.63 |
| pTTv322#60-6 | 3.37 | 4.45 | 4.68 |
| pTTv322#60-12 | 3.30 | 4.15 | 4.29 |
| pTTv322#60-14 | 2.92 | 3.90 | 4.39 |

Site occupancy and glycan analyses. From day 5 supernatant samples, MAB01 was purified using Protein G HP MultiTrap 96-well filter plate (GE Healthcare) according to manufacturer's instructions. Approx. 1.4 ml of culture supernatant was loaded and the elution volume was 230 µl. The antibody concentrations were determined via UV absorbance against MAB01 standard curve.

For site occupancy analysis 16-20 µg of purified MAB01 antibody was taken and antibodies were digested, purified, and analysed as described above. The 100% site occupancy was achieved with *Leishmania infantum* STT3 clones 60-6, 60-12 and 60-14 (Table 69).

TABLE 69

N-glycosylation site occupancy of antibodies from STT3 variants and parental M304 at day 5.

| M304 | | | | |
|---|---|---|---|---|
| Glycosylation state | | % | | |
| Non-glycosylated | | 8 | | |
| Glycosylated | | 92 | | |
| *Leishmania infantum* STT3, Δalg3 | | | | |
| Glycosylation state | 60-2 % | 60-6 % | 60-12 % | 60-14 % |
| Non-glycosylated | 38 | 0 | 0 | 0 |
| Glycosylated | 62 | 100 | 100 | 100 |

These results shows that overexpression of the catalytic subunit of *Leishmania infantum* is capable of increasing the N-glycosylation site occupancy in filamentous fungal cells, up to 100%.

N-glycans were analysed from three of the *Leishmania infantum* STT3 clones. The PNGase F reactions were carried out to 20 µg of MAB01 antibody as described in examples and the released N-glycans were analysed with MALDI-TOF MS. The three strains produced about 25% of Man3 N-glycan attached to MAB01 whereas Hex6 glycoform represents about 60% of N-glycans attached to MAB01 (Table 70).

TABLE 70

Neutral N-glycans and site occupancy analysis of MAB01 from
*L. infantum* STT3 clones at day 5.

*Leishmania infantum* STT3, Δalg3

| | | Clones | | |
|---|---|---|---|---|
| Short | m\z | 60-6 % | 60-12 % | 60-14 % |
| Man3 | 933.3 | 25.9 | 26.4 | 25.9 |
| Man4 | 1095.4 | 9.4 | 9.3 | 9.0 |
| Man5 | 1257.4 | 6.5 | 6.1 | 7.6 |
| Hex6 | 1419.5 | 58.3 | 58.2 | 57.5 |
| Fc | | 0 | 0 | 0 |
| Fc + Gn | | 0 | 0 | 0 |
| Glycosylated | | 100 | 100 | 100 |

This shows that the Man3, G0, G1 and/or G2 glycoforms represent at least 25% of the total neutral N-glycans of MAB01 in 3 different clones overexpressing STT3 from *L. infantum*. FIG. 1 shows the glycan structures of Man3, Man4, Man5, and Hex6 produced in Δalg3 strains (see corresponding structures in column referring to Δalg3 strains in FIG. 1). "Fc" means an Fc fragment (without any N-glycans) and "Fc+Gn" means an Fc fragment with one attached N-acetylglucosamine (possible Endo T enzyme activity could cleave N-glycans of an Fc resulting Fc+Gn).

Example 13

Generation of MAB01 Producing Strains with
Δalg3 or Δalg3 and *L major* STT3 (M420, M602,
and M697-M700)

This example describes the generation of *T. reesei* strains with the following characteristics:
it is deficient for pep1, tsp1, slp1 and alg3 protease genes
it is expressing STT3 gene.

The acetamide marker of the pTTv38 alg3 deletion plasmid was changed to pyr4 marker. The pTTv38 and pTTv142 vectors were digested with NotI and fragments separated with agarose gel electrophoresis. Correct fragments were isolated from the gel with a gel extraction kit (Qiagen) according to manufacturer's protocol. The purified pyr4 loopout marker from pTTv142 was ligated into the pTTv38 plasmid with T4 DNA ligase. The ligation reaction was transformed into electrocompetent TOP10 *E. coli* and grown on ampicillin (100 µg/mp selection plates. Miniprep plasmid preparations were made from four colonies. The orientation of the marker was confirmed by sequencing the clones with primers listed in Table 71. A clone with the marker in inverted direction was chosen to be the final vector pTTv324.

TABLE 71

List of primers used for sequencing
vectors pTTv324

| Primer | Sequence |
|---|---|
| T027_Pyr4_orf_start_rev | TGCGTCGCCGTCTCGCTCCT (SEQ ID NO: 720) |
| T060_pyr4_orf_screen_1F | TGACGTACCAGTTGGGATGA (SEQ ID NO: 721) |

A pyr4− strain of the *Leishmania major* STT3 expressing strain M420 was generated by looping out the pyr4 marker by 5-FOA selection as described in PCT/EP2013/050126. One pyr4− strains was designated with number M602.

To prepare the vectors for transformation, the pTTv324 vector was cut with PmeI to release the deletion cassette. The fragments were separated with agarose gel electrophoresis and the correct fragment was then transformed into protoplasts of the *Trichoderma reesei* M317 and M602. Preparation of protoplasts, transformation, and protoplast plating were carried out as described above.

Transformants were then streaked onto TrMM plates with 0.1% TritonX-100. Transformants growing fast as selective streaks were screened by PCR using the primers listed in Table 72. DNA from mycelia was purified and analyzed by PCR to look at the integration of the 5' and 3' flanks of cassette and the existence of the alg3 ORF. The cassette was targeted into the alg3 locus; therefore the open reading frame was not present in the positively integrated transformants, purified to single cell clones. To screen for 5' integration, sequence outside of the 5' integration flank was used to create a forward primer that would amplify genomic DNA flanking alg3 and the reverse primer was made from sequence in the pyr4 marker of the cassette. To check for proper integration of the cassette in the 3' flank, a reverse primer was made from sequence outside of the 3' integration flank that would amplify genomic DNA flanking alg3 and the forward primer was made from sequence in the pyr4 marker. Thus, one primer would amplify sequence from genomic DNA outside of the cassette and the other would amplify sequence from DNA in the cassette.

TABLE 72

List of primers used for PCR screening of T. reesei transformants.

| 5' flank screening primers: | 1455 bp product |
|---|---|
| T066_104121_5int | GATGTTGCGCCTGGGTTGAC (SEQ ID NO: 722) |
| T060_pyr4_orf_screen_1F | TGACGTACCAGTTGGGATGA (SEQ ID NO: 723) |
| 3' flank screening primers: | 1433 bp product |
| T027_Pyr4_orf_start_rev | TGCGTCGCCGTCTCGCTCCT (SEQ ID NO: 724) |
| T068_104121_3int | GATTGTCATGGTGTACGTGA (SEQ ID NO: 725) |
| alg3 ORF primers: | 689 bp product |
| T767_alg3_del_F | CAAGATGGAGGGCGGCACAG (SEQ ID NO: 726) |
| T768_alg3_del_R | GCCAGTAGCGTGATAGAGAAGC (SEQ ID NO: 727) |

Two M602 strains and seven M317 strains showing proper integration and a deletion of alg3 ORF were grown in large shake flasks in TrMM medium supplemented with 40 g/l lactose, 20 g/l spent grain extract, 9 g/l casamino acids and 100 mM PIPPS, pH 5.5 (Table 73). The M317 strain 19.13 and 19.20 were designated the numbers M697 and M698, respectively, and the M602 strains 1.22 and 11.18 were designated the numbers M699 and M700, respectively.

TABLE 73

Cell dry weight measurements (in g/l) of the parental strains M304 and STT3 expressing strain M420 and alg3 deletion transformants thereof.

| Strain | 3 days | 5 days | 7 days |
|---|---|---|---|
| M602 1.22 | 3.63 | 3.23 | 3.79 |
| M602 11.18 | 3.52 | 3.74 | 4.12 |
| M317 19.1 | 3.64 | 3.84 | 4.22 |
| M317 19.5 | 3.54 | 3.87 | 4.31 |
| M317 19.6 | 3.72 | 3.66 | 4.78 |
| M317 19.13 | 3.63 | 3.21 | 4.06 |
| M317 19.20 | 3.97 | 4.28 | 5.09 |
| M317 19.43 | 3.77 | 4.02 | 4.18 |
| M317 19.44 | 3.58 | 3.78 | 4.17 |
| M420 | 3.31 | 3.69 | 5.57 |
| M304 | 2.55 | 2.99 | 4.09 |

Site occupancy and glycan analyses. Two transformants from overexpression of STT3 from *Leishmania major* in alg3 deletion strain [pTTv324; 1.22 (M699) and 11.18 (M700)] and seven transformants with alg3 deletion [M317, pyr4− of M304; clones 19.1, 19.5, 19.6, 19.13 (M697), 19.20 (M698), 19.43 and 19.44], and their parental strains M420 and M304 were cultivated in shake flasks in TrMM, 4% lactose, 2% spent grain extract, 0.9% casamino acids, 100 mM PIPPS, pH 5.5. MAB01 antibody was purified and analysed from culture supernatants from day 5 as described above except that 30 µg of antibody was digested with 80.4 U of FabRICATOR (Genovis), +37° C., overnight, to produce F(ab')2 and Fc fragments.

In both clones with alg3 deletion and overexpression of LmSTT3 the site occupancy was 100% (Table 74). Without LmSTT3 the site coverage varied between 56-71% in alg3 deletion clones. The improved site occupancy was shown also in parental strain M420 compared to M304, both with wild type glycosylation.

TABLE 74

The site occupancy of the shake flask samples.
The analysis failed in M317 clones 19.5 and 19.6.

| Strain | Clone | Explanation | Site occupancy % |
|---|---|---|---|
| M602 | 1.22 | M304 LmSTT3 Δalg3 | 100 |
| M602 | 11.18 | M304 LmSTT3 Δalg3 | 100 |
| M317 | 19.1 | M304 Δalg3 | 71 |
| M317 | 19.13 | M304 Δalg3 | 62 |
| M317 | 19.2 | M304 Δalg3 | 56 |
| M317 | 19.43 | M304 Δalg3 | 63 |
| M317 | 19.44 | M304 Δalg3 | 60 |
| M420 | | Parental strain M304 LmSTT3 | 100 |
| M304 | | Parental strain | 89 |

For N-glycan analysis MAB01 was purified from day 7 culture supernatants as described above and N-glycans were released from EtOH precipitated and SDS denatured antibody using PNGase F (Prozyme) in 20 mM sodium phosphate buffer, pH 7.3, in overnight reaction at +37° C. The released N-glycans were purified with Hypersep C18 and Hypersep Hypercarb (Thermo Scientific) and analysed with MALDI-TOF MS.

Man3 levels were in range of 21 to 49% whereas the main glycoform in clones of M602 and M317 was Hex6 (Table 75). Man5 levels were about 73% in the strains expressing wild type glycosylation (M304) and LmSTT3 (M420).

TABLE 75

Relative proportions of neutral N-glycans from purified antibody from M602 and M317 clones and parental strains M420 and M304.

|  |  |  | M602 | | M317 | | | | | Parental strains | |
| --- | --- | --- | --- | --- | --- | --- | --- | --- | --- | --- | --- |
| Composition | Short | m\z | 1.22 % | 11.18 % | 19.1 % | 19.13 % | 19.2 % | 19.43 % | 19.44 % | M420 % | M304 % |
| Hex3HexNAc2 | Man3 | 933.3 | 21.1 | 27.3 | 45.4 | 37.5 | 34.9 | 24.6 | 48.6 | 0.0 | 0.0 |
| Hex4HexNAc2 | Man4 | 1095.4 | 9.5 | 8.7 | 6.2 | 7.6 | 7.1 | 7.5 | 9.4 | 0.8 | 0.0 |
| Hex5HexNAc2 | Man5 | 1257.4 | 5.8 | 7.0 | 8.1 | 7.6 | 6.7 | 5.6 | 6.6 | 72.5 | 72.8 |
| Hex6HexNAc2 | Man6/Hex6 | 1419.5 | 63.1 | 56.6 | 39.7 | 45.8 | 51.4 | 61.8 | 34.6 | 15.6 | 16.4 |
| Hex7HexNAc2 | Man7/Hex7 | 1581.5 | 0.5 | 0.5 | 0.6 | 0.8 | 0.0 | 0.5 | 0.7 | 7.2 | 7.9 |
| Hex8HexNAc2 | Man8/Hex8 | 1743.6 | 0.0 | 0.0 | 0.6 | 0.0 | 0.0 | 0.0 | 0.0 | 3.2 | 2.4 |
| Hex9HexNAc2 | Man9/Hex9 | 1905.6 | 0.0 | 0.0 | 0.0 | 0.0 | 0.0 | 0.0 | 0.0 | 0.7 | 0.5 |

Fermentation and site occupancy. L. major STT3 alg3 deletion strain M699 (pTTv324; clone 1.22) and strain M698 with alg3 deletion [M317, pyr4– of M304; clone 19.20], and the parental strain M304 were fermented in 2% YE, 4% cellulose, 8% cellobiose, 4% sorbose. The samples were harvested on day 3, 4, 5 and 6. MAB01 antibody was purified and analysed from culture supernatants from day 5 as described above except that 30 µg of antibody was digested with 80.4 U of FabRICATOR (Genovis), +37° C., overnight, to produce F(ab')2 and Fc fragments.

In the strain M699 site occupancy was more than 90% in all time points (Table 76). Without LmSTT3 the site coverage varied between 29-37% in the strain M698. In the parental strain M304 the site coverage varied between 45-57%. At day 6 MAB01 titers were 1.2 and 1.3 g/L for strains M699 and M698, respectively, and 1.8 g/L in the parental strain M304. In conclusion, overexpression of the catalytic subunit of Leishmania STT3 is capable of increasing the N-glycosylation site occupancy in alg3 filamentous fungal cells up to 91.5-100%.

TABLE 76

MAB01 antibody titers and site occupancy analysis results of fermented strains M699 and M698 and the parental strain M304.

|  | d3 | d4 | d5 | d6 |
| --- | --- | --- | --- | --- |
| M699 | | | | |
| Titer g/l | 0.206 | 0.361 | 0.685 | 1.22 |
| Glycosylation state | % | % | % | % |
| Non-glycosylated | 2.4 | 6.8 | 8.0 | 8.5 |
| Glycosylated | 97.6 | 93.2 | 92.0 | 91.5 |
| Fc + Gn | 0.0 | 0.0 | 0.0 | 0.0 |
| M698 | | | | |
| Titer g/l | 0.252 | 0.423 | 0.8 | 1.317 |
| Glycosylation state | % | % | % | % |
| Non-glycosylated | 63.0 | 70.8 | 64.3 | 65.8 |
| Glycosylated | 37.0 | 29.2 | 35.7 | 34.2 |
| Fc + Gn | 0.0 | 0.0 | 0.0 | 0.0 |
| M304 | | | | |
| Titer g/l | 0.589 | 0.964 | 1.41 | 1.79 |
| Glycosylation state | % | % | % | % |
| Non-glycosylated | 45.9 | 43.3 | n.d. | 54.9 |
| Glycosylated | 54.1 | 56.7 | n.d. | 45.1 |
| Fc + Gn | 0.0 | 0.0 | n.d. | 0.0 |

Fermentation and glycan analysis of strain M698. The M698 strain was fermented in 4% WSG, 2% glucose, 4% cellobiose and 6% lactose and sampling was performed at days 3-6. The N-glycan analysis was performed as described above. The results are shown in Table 77. Without GLSIIa overexpression the proportion of Hex6 is 61% and there is 31% of Man3 glycoform on antibody.

TABLE 77

Relative proportions (%) of the predominant neutral N-glycans from purified antibody from strain M698 fermented in WSG medium for 5 days.

| Hex6 | Man3 | GnMan3 | G0 |
| --- | --- | --- | --- |
| 61 | 31 | 0 | 0 |

Example 14

Generation of ΔPMT1 Strain

Generation of pmt1 deletion plasmids. Three different deletion plasmids (pTTv36, pTTv124, pTTv185) were constructed for deletion of the protein O-mannosyltransferase gene pmt1 (TreID75421). All the plasmids contain the same 5' and 3' flanking regions for correct integration to the pmt1 locus. The difference between the three plasmids is the marker used in the selection; pTTv36 contains a gene encoding acetamidase of Aspergillus nidulans (amdS), pTTv124 contains a loopout version (blaster cassette) of the amdS marker and pTTv185 a loopout version (blaster cassette) of a gene encoding orotidine-5'-monophosphate (OMP) decarboxylase of T. reesei (pyr4).

The third deletion construct, pTTv185, for the protein O-mannosyltransferase gene pmt1 (TreID75421) was designed to enable removal of the selection marker from the Trichoderma reesei genome after successful integration and thereby recycling of the selection marker for subsequent transformations. In this approach, the recycling of the marker, i.e. removal of pyr4 gene from the deletion construct, resembles so called blaster cassettes developed for yeasts (Hartl, L. and Seiboth, B., 2005, Curr Genet 48:204-211; and Alani, E. et al., 1987, Genetics 116:541-545). Similar blaster cassettes have also been developed for filamentous fungi including Hypocrea jecorina (anamorph: T. reesei) (Hartl, L. and Seiboth, B., 2005, Curr Genet 48:204-211).

The TreID number refers to the identification number of a particular protease gene from the Joint Genome Institute Trichoderma reesei v2.0 genome database. Primers for construction of deletion plasmids were designed either manually or using Primer3 software (Primer3 website, Rozen and Skaletsky (2000) Bioinformatics Methods and Protocols: Methods in Molecular Biology. Humana Press, Totowa, N.J., pp 365-386).

The principle of the blaster cassette using pyr4 as the marker gene is as follows: pyr4, encoding orotidine-5'-monophosphate (OMP) decarboxylase of *T. reesei* (Smith, J. L., et al., 1991, Current Genetics 19:27-33) is needed for uridine synthesis. Strains deficient for OMP decarboxylase activity are unable to grow on minimal medium without uridine supplementation (i.e. are uridine auxotrophs). The utilisation of 5-fluoroorotic acid (5-FOA) in generation of mutant strains lacking OMP decarboxylase activity (pyr4$^-$ strains) is based on the conversion of 5-FOA to a toxic intermediate 5-fluoro-UMP by OMP decarboxylase. Therefore, cells which have a mutated pyr4 gene are resistant to 5-FOA, but in addition are also auxotrophic for uridine. The 5-FOA resistance can in principle result also from a mutation in another gene (pyr2, orotate phosphoribosyltransferase), and therefore the spontaneous mutants obtained with this selection need to be verified for the pyr4$^-$ genotype by complementing the mutant with the pyr4 gene. Once mutated, the pyr4 gene can be used as an auxotrophic selection marker in *T. reesei*. In our blaster cassette pyr4 is followed by a 310 bp direct repeat of pyr4 5' untranslated region (5'UTR) and surrounded by 5' and 3' flanking regions of the gene to be deleted. Integration of the deletion cassette is selected via the pyr4 function. Removal of the pyr4 marker is then forced in the presence of 5-FOA by recombination between the two homologous regions (direct repeat of 5'UTR) resulting in looping out of the selection marker and enabling the utilisation of the same blaster cassette (pyr4 loopout) in successive rounds of gene deletions. After looping out, only the 310 bp sequence of 5'UTR remains in the locus.

Thus, the pyr4 selection marker and the 5' direct repeat (DR) fragment (310 bp of pyr4 5'UTR) were produced by PCR using plasmid containing a genomic copy of *T. reesei* pyr4 as a template. Both fragments contained 40 bp overlapping sequences needed to clone the plasmid with the loopout cassette using homologous recombination in yeast (see below). To enable possible additional cloning steps, an AscI digestion site was placed between the pyr4 marker and the 5' direct repeat and NotI sites to surround the complete blaster cassette.

1100 bp of 5' and 1000 bp of 3' flanking regions were selected as the basis of the pmt1 deletion plasmids. The flanking region fragments were produced by PCR using a *T. reesei* wild type strain QM6a (ATCC13631) as the template. For the yeast homologous recombination system used in cloning (see below), overlapping sequences for the vector and the selection marker were placed to the appropriate PCR-primers. To enable marker switch in the construct, NotI restriction sites were introduced between the flanking regions and the selection marker. PmeI restriction sites were placed between the vector and the flanking regions for removal of vector sequence prior to transformation into *T. reesei*. Vector backbone pRS426 was digested with restriction enzymes (EcoRI and XhoI).

First deletion plasmid for pmt1 (plasmid pTTv36, Table 78) used amdS, a gene encoding acetamidase of *Aspergillus nidulans*, as the marker. The marker cassette was digested from an existing plasmid pHHO1 with NotI. All fragments used in cloning were separated with agarose gel electrophoresis and correct fragments were isolated from the gel with a gel extraction kit (Qiagen) using standard laboratory methods.

To construct the first deletion plasmid pTTv36, the vector backbone and the appropriate marker and flanking region fragments were transformed into *Saccharomyces cerevisiae* (strain H3488/FY834). The yeast transformation protocol was based on the method for homologous yeast recombination described in the *Neurospora* knockouts workshop material of Colot and Collopy, (Dartmouth *Neurospora* genome protocols website), and the Gietz laboratory protocol (University of Manitoba, Gietz laboratory website). The plasmid DNA from the yeast transformants was rescued by transformation into *Escherichia coli*. A few clones were cultivated, plasmid DNA was isolated and digested to screen for correct recombination using standard laboratory methods. A few clones with correct insert sizes were sequenced and stored.

To clone the second pmt1 deletion plasmid (pTTv124, Table 78), the amdS marker was removed from the deletion plasmid pTTv36 with NotI digestion and replaced by another variant of the blaster cassette, amdS loopout cassette containing the amdS selection marker gene, followed by AscI restriction site and a 300 bp direct repeat of amdS 5'UTR. The amdS blaster cassette functions in a similar manner to the pyr4 blaster cassette. The clones containing the amdS blaster cassette are able to grow on acetamide as sole nitrogen source. On medium containing 5-fluoroacetamide (5-FAA) a functional amdS gene will convert 5-FAA to a toxic fluoroacetate and therefore, in the presence of 5-FAA, removal of amdS gene is beneficial to the fungus. Removal of amdS blaster cassette is enhanced via the 300 bp DRs in the cassette like in the pyr4 blaster cassette, which enables the amdS gene to loop out via single crossover between the two DRs. Resulting clones are resistant to 5-FAA and unable to grow on acetamide as the sole nitrogen source.

The fragments needed for the amdS blaster cassette were produced by PCR using a plasmid p3SR2 (Hynes M. J. et al, 1983, Mol. Cell. Biol. 3:1430-1439) containing a genomic copy of the amdS gene as the template. For the yeast homologous recombination system used in cloning (see above), overlapping sequences were placed to the appropriate PCR-primers. To enable marker switch in the construct, NotI restriction sites were kept between the flanking regions and the blaster cassette. Additional restriction sites FseI and AsiSI were introduced to the 5' end of amdS and an AscI site between amdS and amdS 5'DR. The plasmid pTTv124 was constructed using the yeast recombination system described above. The plasmid DNA from the yeast transformants was rescued by transformation into *Escherichia coli*. A few clones were cultivated, plasmid DNA was isolated and digested to screen for correct recombination using standard laboratory methods. A few clones with correct insert sizes were sequenced and stored.

To clone the third pmt1 deletion plasmid (pTTv185, Table 78), the amdS marker was removed from the deletion plasmid pTTv36 with NotI digestion and replaced by the pyr4 blaster cassette described above. The pyr4 blaster cassette was obtained from another plasmid with NotI digestion, ligated to NotI cut pTTv36 and transformed into *E. coli* using standard laboratory methods. A few transformants were cultivated, plasmid DNA isolated and digested to screen for correct ligation and orientation of the pyr4 blaster cassette using standard laboratory methods. One clone with correct insert size and orientation was sequenced and stored.

These deletion plasmids for pmt1 (pTTv36, pTTv124 and pTTv185) result in 2465 bp deletion in the pmt1 locus and cover the complete coding sequence of PMT1.

TABLE 78

Primers for generating deletion plasmids pTTv36, pTTv124 and pTTv185 for protein O-mannosyltransferase 1 (pmt1, TreID75421)

| Primer | Sequence |
| --- | --- |
| Deletion plasmid pTTv36 for pmt1 (TreID75421), vector backbone pRS426 | |
| 75421_5'F | CGATTAAGTTGGGTAACGCCAGGGTTTTCCCAGTCACGACGGTTTAAACGCTGCAGG GCGTACAGAACT (SEQ ID NO: 288) |
| 75421_5'R | ATCTCTCAAAGGAAGAATCCCTTCAGGGTTGCGTTTCCAGTGCGGCCGCGGCTCTAA AATGCTTCACAG (SEQ ID NO: 289) |
| 75421_3'F | CGGTTCTCATCTGGGCTTGCTCGGTCCTGGCGTAGATCTAGCGGCCGCACGATGATG ATGACAGCCAG (SEQ ID NO: 290) |
| 75421_3'R | GTGGAATTGTGAGCGGATAACAATTTCACACAGGAAACAGCGTTTAAACCGTCCAGCT CCCGCAGCGCC (SEQ ID NO: 291) |
| Deletion plasmid pTTv124 for pmt1 (TreID75421), vector backbone pTTv36 | |
| T282_75421_amds_5for | ATCGCTAACTGCTTTCTCTTCTGTGAAGCATTTTAGAGCCGCGGCCGCGG CCGGCCGCGATCGCCTAGATCTACGCCAGGACCG (SEQ ID NO: 292) |
| T283_amds_3rev_loop | CGGTCCTGGCGTAGATCTAGGGCGCGCCACTGGAAACGCAACCCTGAA (SEQ ID NO: 293) |
| T284_amds_loop_5for | TTCAGGGTTGCGTTTCCAGTGGCGCGCCCTAGATCTACGCCAGGACCG (SEQ ID NO: 294) |
| T287_75421_loop_3rev | AGCATCATGACCGCCCCCTTCTGGCTGTCATCATCATCGTGCGGCCGCG ATTATTGCACAAGCAGCGA (SEQ ID NO: 295) |
| Deletion plasmid pTTv185 for pmt1 (TreID75421), vector backbone pTTv36 | |
| no new primers, pTTv36 digested with NotI and ligated with pyr4-loopout fragment obtained from another plasmid | |

Generation of pmt1 deletion strains M403, M404, M406 and M407. To generate a pyr4 negative target strain suitable for the deletion of pmt1 using plasmid pTTv185, the MAB01 antibody producing strain M304 was subjected to selection in the presence of 5-fluoro-orotic acid in order to select for strains containing impaired pyr4 genes. The generation of the strain M304 is described in WO2013/102674. T. reesei strain M304 comprises MAB01 light chain fused to T. reesei truncated CBH1 carrier with NVISKR Kex2 cleavage sequence, MAB01 heavy chain fused to T. reesei truncated CBH1 carrier with AXE1 [DGETVVKR] Kex2 cleavage sequence, Δpep1Δtsp1Δslp1, and overexpresses T. reesei KEX2.

Spores of M304 were spread onto minimal medium plates containing 20 g/l glucose, 2 g/l proteose peptone, 5 mM uridine and 1.5 g/l 5-FOA, pH 4.8. Some 5-FOA resistant colonies were streaked after 5-7 days onto plates described above with 1 ml/l Triton X-100 supplementation. A few clones were further purified to single cell clones via consecutive purification platings: a small piece of mycelia was picked to 0.8% NaCl—0.025% Tween 20—20% glycerol, suspended thoroughly by vortexing and filtrated through a cotton-filled pipette tip. Purified clones were sporulated on plates containing 39 g/l potato dextrose agarose. These clones were tested for uridine auxotrophy by plating spores onto minimal medium plates (20 g/l glucose, 1 ml/l Triton X-100, pH 4.8) with and without 5 mM uridine supplementation. No growth was observed on plates without uridine indicating the selected clones were putative pyr4⁻. Clones were stored for future use and one of them was designated with strain number M317.

Pmt1 was deleted from M317 (pyr4⁻ of the strain M304) using the pmt1 deletion cassette from plasmid pTTv185 described above. To remove the vector sequence, plasmid pTTv185 (Δpmt1-pyr4) was digested with PmeI+XbaI and the correct fragment was purified from an agarose gel using QIAquick Gel Extraction Kit (Qiagen). Approximately 5 μg of the pmtI deletion cassette was used to transform strain M317. Preparation of protoplasts and transformation for pyr4 selection were carried out essentially according to methods in Penttila et al. (1987, Gene 61:155-164) and Gruber et al (1990, Curr. Genet. 18:71-76).

100 colonies were picked as selective streaks. 40 transformants were screened by PCR using the primers in Table 79 for the correct integration of the deletion cassette using standard laboratory methods. 12 putative deletion clones were purified to single cell clones. Purified clones were rescreened for integration and for deletion of pmt1 ORF using primers on Table 80. Four clones (in duplicate) were pure disruptants (i.e. no signal with ORF primers).

TABLE 79

Primers for screening integration of deletion cassette pTTv185 and for deletion of protein O-mannosyl-transferase 1 (pmt1, TreID75421) from M317.

| Primer | Sequence |
| --- | --- |
| T296_75421_5int | TATGGCTTTAGATGGGGACA (SEQ ID NO: 296) |
| T027_Pyr4_orf_start_rev | TGCGTCGCCGTCTCGCTCCT (SEQ ID NO: 297) |

TABLE 79-continued

Primers for screening integration of
deletion cassette pTTv185 and for
deletion of protein O-mannosyl-
transferase 1 (pmt1, TreID75421)
from M317.

| Primer | Sequence |
| --- | --- |
| T061_pyr4_orf_screen_2F | TTAGGCGACCTCTTTTTCCA (SEQ ID NO: 298) |
| T297_75421_3int | CCTGTATCGTCCTGTTCC (SEQ ID NO: 299) |
| T359_pmt1_orf_for | GCGCCTGTCGAGTCGGCATT (SEQ ID NO: 300) |
| T360_pmt1_orf_rev | CACCGGCCATGCTCTTGCCA (SEQ ID NO: 301) |
| T756_pmt1_orf_for2 | CAAGGTGCCCTATGTCGC (SEQ ID NO: 302) |
| T757_pmt1_orf_rev2 | GATCGGGTCAGGACGGAA (SEQ ID NO: 303) |

Deletion of pmt1 was verified by Southern analyses. DNA for Southern analyses was extracted with Easy-DNA kit for genomic DNA isolation (Invitrogen) essentially according to the manufacturer's instructions.

Southern analyses were essentially performed according to the protocol for homologous hybridizations in Sambrook et al. (1989, Molecular Cloning: A laboratory manual. $2^{nd}$ Ed., Cold Spring Harbor Laboratory Press) using radioactive labeling ($^{32}$P-dCTP) and DecaLabel Plus kit (Fermentas). Southern digestion schemes were designed using Geneious Pro software (Geneious website). Fragments for probes were produced by PCR using the primers listed in Table 81 using a *T. reesei* wild type strain QM6a (ATCC13631) as the template. PCR products were separated with agarose gel electrophoresis and correct fragments were isolated from the gel with a gel extraction kit (Qiagen) using standard laboratory methods.

TABLE 81

Primers for production of probe fragments
used in Southern analyses of protein
O-mannosyltrans-ferase 1 (pmt1,
TreID75421) deletion strains.

| Primer | Sequence |
| --- | --- |
| T635_pmt1_5f_for | AGCCTGTCTGAGGGACGG (SEQ ID NO: 304) |
| T636_pmt1_5f_rev | CAAGGTCGAGATTCGGCA (SEQ ID NO: 305) |
| T637_pmt1_3f_for | CAGAAGGGGCGGTCAT (SEQ ID NO: 306) |
| T638_pmt1_3f_rev | GTCCCAGCTCCCGCTCT (SEQ ID NO: 307) |
| T359_pmt1_orf_for | GCGCCTGTCGAGTCGGCATT (SEQ ID NO: 308) |
| T360_pmt1_orf_rev | CACCGGCCATGCTCTTGCCA (SEQ ID NO: 309) |

None of the clones hybridised with pmt1 ORF probe indicating successful deletion of pmt1. Analyses using 5' and 3' flank probes revealed that four of the clones were single integrants. Four clones gave additional signals and thus indicated multiple integration of the deletion cassette. Four pure clones (with and without additional copies of the deletion cassette) have been stored for future use (M403; 26-8A, M404; 26-19A, M406; 26-16B and M407; 26-19B).

Analyses of Δpmt1 strains M403, M404, M406 and M407. Shake flask cultivation of *T. reesei* M304 and eight pmt1 deletion strains (26-8A (M403), 26-8B, 26-16A, 26-16B (M406), 26-19A (M404), 26-19B (M407), 26-21A, 26-21B) was carried out in *Trichoderma* minimal medium with 40 g/l lactose, 20 g/l spent grain extract, 100 mM PIPPS, 9 g/l casamino acids, pH 5.5 at +28° C., 200 rpm. Samples were collected on days 3, 5, 7 and 10 by vacuum filtration. Supernatant samples were stored to −20° C. (antibody and glycan analyses) or used in pH determinations. Mycelia for cell dry weight determinations were rinsed once with DDIW and dried at +100° C. for 20-24 h. Mycelia for genomic DNA extraction were rinsed once with DDIW and stored to −20° C.

O-mannosylation status analysis was performed to shake flask cultivations of *T. reesei* M304, eight pmt1 disruptants (pTTv185: 26-8A, 26-8B, 26-16A, 26-16B, 26-19A, 26-19B, 26-21A, 26-21B). All were cultivated in TrMM—40 g/l lactose—20 g/l SGE—100 mM PIPPS—9 g/l casamino acids, pH 5.5 at +28° C. and samples were taken on time point days 3, 5, 7 and 10.

MAB01 antibody from each sample from day 7 was purified from supernatants using Protein G HP MultiTrap 96-well plate (GE Healthcare) according to manufacturer's instructions. The antibody was eluted with 0.1 M citrate buffer, pH 2.6 and neutralized with 2 M Tris, pH 9. The concentration was determined via UV absorbance in spectrophotometer against MAB01 standard curve. For O-mannosylation analysis, 10 µg of protein was incubated in 6 M Guanidinium HCl for 30 minutes at +60° C. after which 5 µl of fresh 0.1 M DTT was added and incubated again as above. The samples were purified using Poros R1 96-well plate and the resulting light chains were analysed using MALDI-TOF MS. All were made as duplicates.

Figure 17:
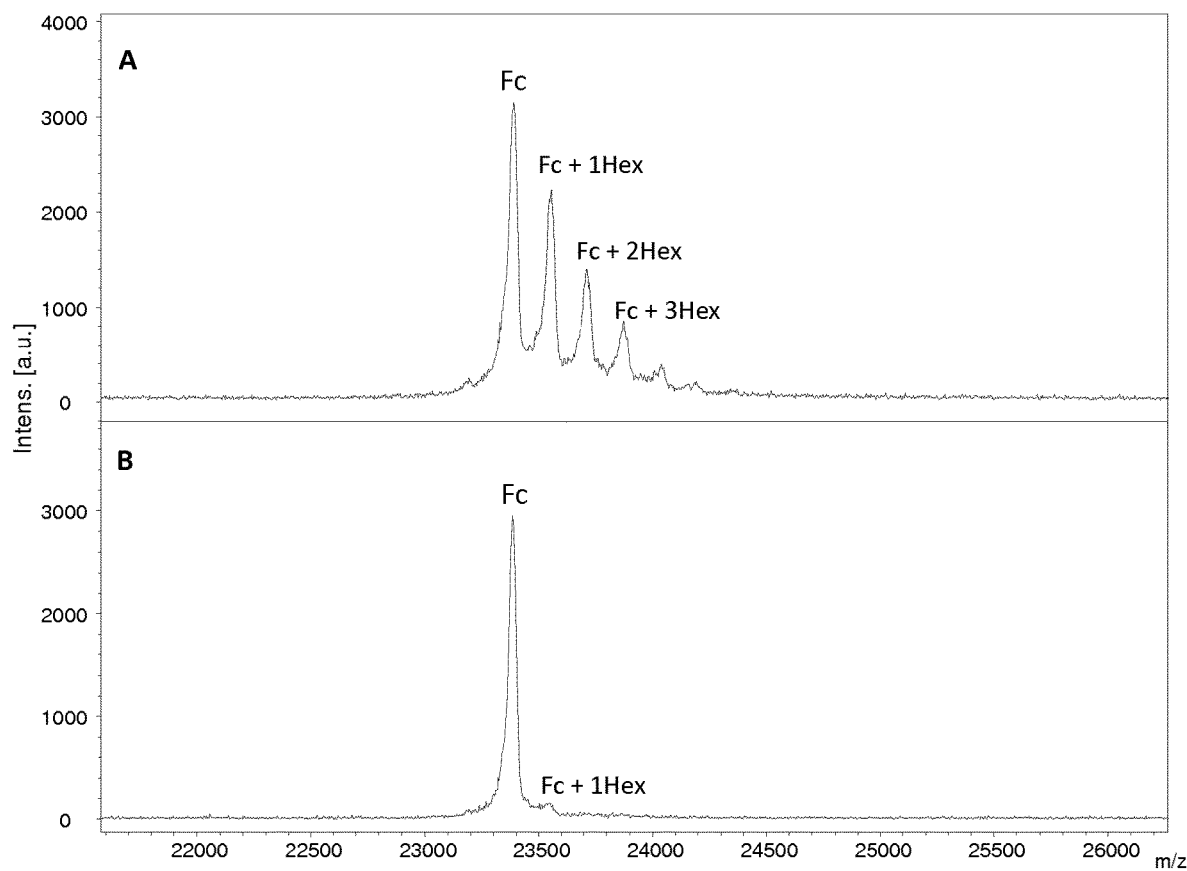
FIG. 17 depicts a spectra of light chain of flask cultured parental *T. reesei* strain M317 (pyr4− of M304) (A) and Δpmt1 disruptant clone 26-8A (B), day 7.

In flask cultures the O-mannosylation status in pmt1 disruptants was remarkably changed; all Δpmt1 disruptants looked the same—nearly complete loss of O-mannosylation in MAB01 LC (FIG. 17).

Fermentation of Δpmt1 strain M403. Fermentation was carried out with Δpmt1 strain M403 (clone 26-8A; pTTv185 in M317). Fermentation culture medium contained 30 g/l glucose, 60 g/l lactose, 60 g/l whole spent grain at pH 5.5. Lactose feed was started after glucose exhaustion. Growth temperature was shifted from +28° C. to +22° C. after glucose exhaustion. Samples were collected by vacuum filtration. Supernatant samples were stored to −20° C.

Figure 18:
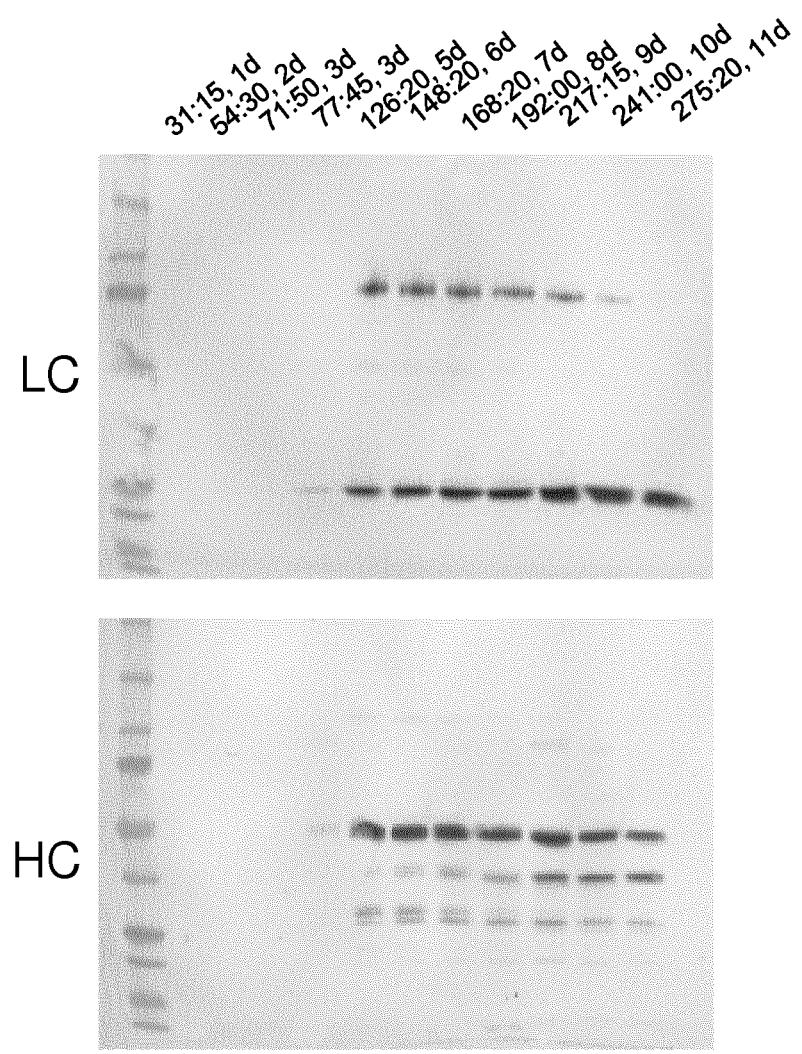
FIG. 18 depicts results for Western analyses of *Trichoderma reesei* pmt1 deletion strain M403 from fed-batch fermentation. Upper panel: MAB01 light chain, lower panel: MAB01 heavy chain. 0.1 µl of supernatant was loaded on each lane.

In FIG. 18 is shown the Western analyses of supernatant samples. MAB01 heavy and light chains were detected from supernatant after day three. Despite the deletion of pmt1, that could also reduce O-mannosylation of the linker and thus aid KEX2 cleavage, substantial amount of light chain remains attached to the carrier in the early days of the fermentation. At later stages, the cleavage is more complete but the yield may be affected by the degradation of the heavy chain. Results on antibody titres (Table 83 below) indicate fairly steady expression between days 7 to 10. In this fermentation the pmt1 deletion strain produced approximately equal antibody levels as the parental strain. Higher titres were obtained when the same strain was fermented using a different fermenter.

Figure 19:
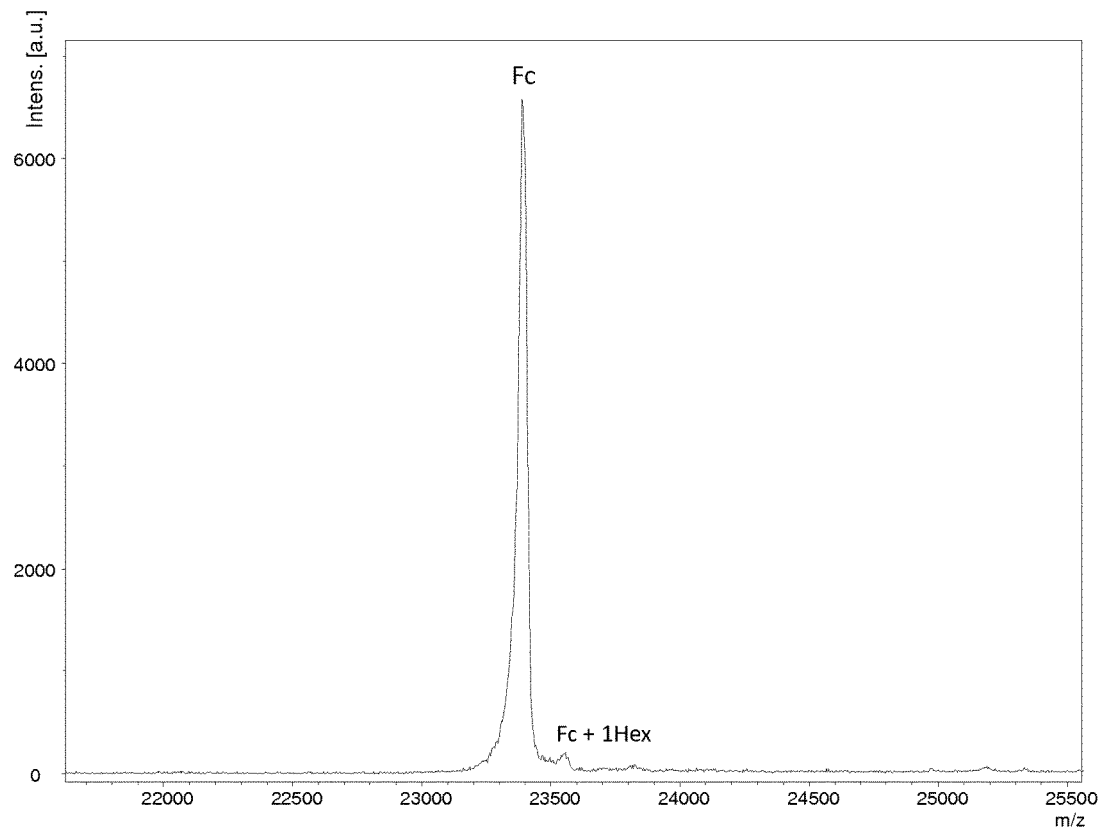
FIG. 19 depicts a spectrum of light chain of fermenter cultured *T. reesei* strain M403 (pmt1 deletion strain of MAB01 antibody producing strain, clone 26-8A), day 7.

M403 (clone 26-8A) was cultivated in fermenter in TrMM, 30 g/l glucose, 60 g/l lactose, 60 g/l spent grain, pH 5.5 with lactose feed. Samples were harvested on days 2, 3 and 5-11. O-mannosylation level analysis was performed as to flask cultures. The O-mannosylation status was greatly decreased also in fermenter culture (FIG. 19, Table 80).

The O-mannosylation level was calculated from average of area and intensity (Table 80). Area (Table 82) seems to give more commonly higher rate of non-O-glycosylated LC than intensity (Table 83). In all time points the O-mannosylation level was below 5%.

TABLE 80

O-mannosylation status of *T. reesei* strain M403 (pmt1 deletion strain of MAB01 antibody producing strain, clone 26-8A) from fermenter culture. Percentages calculated from area and intensity of single charged signals. In time point d 9 both samples gave 100% to LC, LC + Hex1 being practically absent.

|        | 3d Average | 5d Average | Std  | 6d Average | Std  | 7d Average | Std  | d8 Average | d9 Average | d10 Average | Std | d11 Average | Std  |
|--------|------------|------------|------|------------|------|------------|------|------------|------------|-------------|-----|-------------|------|
| LC     | 95.8       | 96.8       | 0.30 | 97.5       | 0.29 | 97.4       | 0.36 | 97.3       | 100.0      | 96.6        | 0.2 | 95.5        | 0.11 |
| LC + Hex | 4.2      | 3.2        | 0.30 | 2.5        | 0.29 | 2.6        | 0.36 | 2.7        | 0.0        | 3.4         | 0.2 | 4.5         | 0.11 |

TABLE 82

The percentages of area values of three parallel samples from fermenter cultured M403 from day 7.

|          | Area average | Std  |
|----------|--------------|------|
| LC       | 98.5         | 0.15 |
| LC + Hex | 1.5          | 0.15 |

TABLE 83

The percentages of intensity values of three parallel samples from fermenter cultured M403 from day 7.

|          | Intensity average | Std  |
|----------|-------------------|------|
| LC       | 96.3              | 0.57 |
| LC + Hex | 3.7               | 0.57 |

No negative effects of strain growth characteristic and secretion capacity were observed. The strain M403 grew well and produced increased amount of antibody in function of time in fermenter culture. The best titer was obtained from day 10 (Table 84). On day 11 the titer is decreased.

TABLE 84

Titers from fermenter cultured MAB01 producing strain M403. The antibody was purified using Protein G 96-well plate.

| Time point   | Days cultured | Titer g/l |
|--------------|---------------|-----------|
| 54:30 hours  | 2             | 0.04      |
| 71:50 hours  | 3             | 0.04      |
| 77:45 hours  | 3             | 0.07      |
| 126:20 hours | 5             | 0.91      |
| 148:20 hours | 6             | 1.23      |
| 168:20 hours | 7             | 1.47      |
| 192:00 hours | 8             | 1.50      |
| 217:15 hours | 9             | 1.35      |
| 241:00 hours | 10            | 1.52      |
| 275:20 hours | 11            | 1.06      |

Deletion of pmt1 diminished dramatically MAB01 O-mannosylation; the amount of O-mannosylated LC was ~61% in parental strain, 3% in the best Δpmt1 clone in shake flask culture and practically 0% in fermenter culture in time point day 9.

Deletion of pmt1 in a Fab expressing *Trichoderma reesei* Strain. The pmt1 disruption cassette (pmt1 amdS) was released from its backbone vector pTTv124 described above by restriction digestion and purified through gel extraction. Using protoplast transformation the deletion cassette was introduced to *T. reesei* strains M304 (3-fold protease deletion strain expressing MAB01) and M307 (4-fold protease deletion strain Δpep1Δtsp1Δslp1Δgap1, also described in WO2013/102674 that has been transformed to express a Fab). Transformants were plated to acetamidase selective medium (minimal medium containing acetamide as the sole carbon source).

Transformants were screened by PCR for homologous integration of the acetamidase marker to the pmt1 locus using a forward primer outside the 5' flanking region fragment of the construct and the reverse primer inside the AmdS selection marker (5' integration) as well as a forward primer inside the AmdS selection marker and a reverse primer outside the 3' flanking region fragment (3' integration). Three independent transformants of each transformation (MAB01 and Fab expressing strains), which gave PCR results displaying correct integration of the construct to the pmt1 locus were selected for single spore purification to obtain uninuclear clones. Proper integration of the disruption cassette was reconfirmed by PCR using the same primer combinations as described above and the absence of the pmt1 gene was verified by using a primer combination targeted to the pmt1 open reading frame. Correct integration of the disruption cassette was additionally verified for all clones applying Southern hybridization. Digested genomic DNA of the three clones as well as the parental strain were probed against the 5' and 3' flanks of the pmt1 gene to confirm modification of the pmt1 locus as expected. Furthermore, the blotted DNA was hybridized with a probe specific to the pmt1 open reading frame in order to substantiate the absence of pmt1.

MAB01 and Fab expression for O-mannosylation Analysis. To evaluate the impact of pmt1 deletion on O-mannosylation levels of mAb and Fab molecules, strains were grown in batch fermentations for 7 days, in media containing 2% yeast extract, 4% cellulose, 4% cellobiose, 2% sorbose, 5 g/L KH2PO4, and 5 g/L (NH4)2SO4. Culture pH was controlled at pH 5.5 (adjusted with NH4OH). The starting temperature was 30° C., which was shifted to 22° C. after 48 hours. mAb fermentations (strains M304, M403, M406 and M407) were carried out in 4 parallel 2L glas reactor vessels (DASGIP) with a culture volume of 1L and the Fab fermentation (TR090#5) was done in a 15L steel tank reactor (Infors) with a culture volume of 6L. Fab strains (TR090#5, TR090#3, TR090#17) were additionally cultured in shake flasks for 4 days at 28° C. Main media components were 1% yeast extract, 2% cellobiose, 1% sorbose, 15 g/L KH2PO4 and 5 g/L (NH4)2SO4 and the pH was uncontrolled (pH drops from 5.5 to <3 during a time course of cultivation).

Culture supernatant samples were taken during the course of the runs and stored at −20° C. Samples were collected daily from the whole course of these cultivations, and production levels were analyzed by affinity liquid chromatography. Samples with maximum production levels were subject to purification and further O-mannosylation analysis.

Analysis of O-mannosylation on Fab and mAb. O-mannosylation was analyzed on mAb and Fab molecules expressed from both, the pmt1 deletion and parental strains. The mAb and Fab was purified from culture supernatants using Lambda Select Sure and CaptureSelect Fab Lambda (BAC) affinity chromatography resin, respectively, applying conditions as described by the manufactures protocols. Both purified molecules including, the purified mAb and Fab were subjected to RP-LC-QTOF-MS either as intact and/or reduced/alkylated samples.

For intact analysis, an equivalent of 20 µg protein was injected onto the column. For reduced/alkylated analyses of mAb, an equivalent of 100 µg protein was deglycosylated using PNGase-F enzyme, reduced using DTT and alkylated using iodoacetamide prior to LC-MS analysis. For reduced/alkylated analyses of Fab, an equivalent of 100 µg protein was reduced with DTT and alkylated with iodoacetamide prior to LC-MS analysis. 6 µg of the reduced/alkylated sample were injected onto the column. Reversed-phase chromatography separation was carried out on a 2.1×150 mm Zorbax C3 column packed with 5 µm particles, 300 Å pore size the eluents were: eluent A 0.1% TFA in water and eluent B 0.1% TFA in 70% IPA, 20% ACN, 10% water. The column was heated at 75° C. and the flo rate was 200 µL/min. The gradient used for the sample separation is shown in Table 85.

TABLE 85

HPLC gradient used for intact and reduced/alkylated samples

| Time | % B | Flow (mL/min) |
|---|---|---|
| 0 | 10 | 0.1 |
| 0.1 | 10 | 0.2 |
| 2 | 10 | 0.2 |
| 4 | 28 | 0.2 |
| 30 | 36.4 | 0.2 |
| 31 | 100 | 0.2 |
| 34 | 100 | 0.2 |
| 35 | 10 | 0.2 |
| 40 | 10 | 0.2 |

The HPLC was directly coupled with a Q-TOF Ultima mass spectrometer (Waters, Manchester, UK). The ESI-TOF mass spectrometer was set to run in positive ion mode. The data evaluation of intact and reduced/alkylated analyses was performed using MassLynx analysis software (Waters, Manchester, UK). The deconvolution of the averaged mass spectra from the main UV signals was carried out using the MaxEnt algorithm, a part of the MassLynx analysis software (Waters, Manchester, UK). The deconvolution parameters were the following: "max numbers of iterations" are 8; resolution is 0.1 Da/channel; Uniform Gaussian—width at half height is 1 Da for intact and 0.5 for the reduced chains and minimum intensity ratios are left 30% and right 30%. The estimated level of O-mannosylation (%) was determined using the peak signal height after deconvolution. The observed O-mannosylation levels (%) of mAbs and Fabs from independent pmt1 deletion strains are compared to the ones of the respective parental wild-type strains in Tables 86 and 87.

TABLE 86

O-mannosylation level [%] of Fabs from different strains.

| | Strain | | | |
|---|---|---|---|---|
| Sample | Parental M307 | TR090#5 | TR090#3 | TR090#17 |
| Intact Fab | 70.1 | 34.2 | 34.3 | 34.7 |
| LC | 58.8 | 10.4 | 10.1 | 10.8 |
| HC | 42.9 | 26.1 | 25.9 | 25.8 |

TABLE 87

O-mannosylation level [%] of MAB01 from different pmt1 deficient strains M403, M406 and M407. Parental strain is M304.

| | Strain in yeast extract medium | | | |
|---|---|---|---|---|
| Sample | Parental | M403 | M406 | M407 |
| LC | 50.7 | 5.7 | 5.8 | 5.8 |
| HC | 4.8 | Not detected | Not detected | Not detected |

The O-mannosylation level was found to be 70% on intact Fab derived from the parental strain and reduced to ~34% in all three pmt1 deletion strains. The transfer of mannoses was more efficiently diminished on the Fab light chains (10% of residual O-mannosylation on light chains obtained from pmt1 deletion strains vs. 59% for the parental strain), as compared to the heavy chains, for which it decreased from 43% to ~26%.

The O-mannosylation level was found to be 50% on the light chain of mAb derived from parental strains and reduced to 5.7-5.8% in all three pmt1 deletion strains. The O-mannosylation level was found to be 4.8% on the heavy chain of mAb derived from parental strains and was completely reduced (below the limit of detection by LC-MS) in all three pmt1 deletion strains.

In conclusion, after deletion of pmt1, almost 95% of purified mAb and 70% of Fab molecules did no longer contain any O-mannose residues. Therefore, pmt1 is a valuable target to reduce O-mannosylation of secreted proteins and to improve product quality of biopharmaceuticals produced by *Trichoderma reesei*.

Example 15

Generation of MAB01 Expressing Strain TR222 with LmSTT3, endoT and Pmt1 Deletions, and *T. reesei* ManI Overexpression This examples describes the generation of *T. reesei* strain having the following characteristics:
it is deficient for pep1, tsp1, slp1, gap1, gap2, pep4, pep3, pep5, pmt1 protease genes and endoT genes,
it comprises LmSTT3 gene,
it overexpresses *T. reesei* α1,2 mannosidase gene.

The resulting strain TR222 is producing MAB01 with high amount of Man5 glycoform (92.4%).

Figure 20:
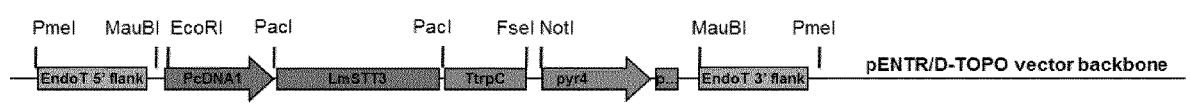
FIG. 20 Scheme of the pTTn088-encoded expression/recombination cassette for LmSTT3 overexpression and EndoT deletion FIG. 21 Scheme of the pTTn040-encoded expression/recombination cassette for MAB01 expression from the cbh1 locus FIG. 22 Scheme of the pTTn160-encoded expression/recombination cassette for TrMns1 overexpression and pmt1 deletion.

Generation of strain TR222. The plasmid pTTn088 was constructed for overexpression of LmSTT3 and deletion of the EndoT gene (TreID65162) (FIG. 20). LmSTT3 expression is driven by the constitutive cDNA1 promoter, and terminated by the trpC terminator. The *T. reesei* orotidine-5'-monophosphate (OMP) decarboxylase (pyr4 gene) is used as the selection marker in a loop-out design to facilitate recycling of the marker. The entire expression cassette is designed for targeted integration to the EndoT locus by flanking it with homologous 5' and 3' DNA sequences. Apart from this expression cassette, pTTn088 contains the vector backbone of pENTR/D-TOPO (Invitrogen).

Figure 21:

The vector pTTn040 comprises an expression cassette for MAB01. To allow high-level expression and secretion, both, heavy and light chains are expressed as fusions to the cbhl catalytic domain. Their expression is regulated by the cbhl promoter and terminator. The release of the LC and HC from the cbhl carrier is achieved co-secretionally by using a recognition motif for the endogenous Kex2 protease of *Trichoderma reesei*. The entire expression cassette additionally encodes a Hygromycin B resistance marker for selection and is targeted to the cbhl locus using corresponding homology flanks. pTTn040 uses a vector backbone for propagation in *E. coli* (FIG. 21).

Figure 22:
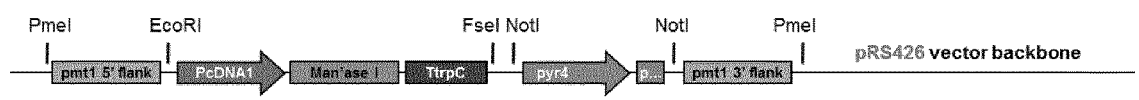

The plasmid pTTn160 was constructed for overexpression of *T. reesei* ManI and deletion of the pmt1 gene (TreID75421) (FIG. 22). *T. reesei* ManI expression is driven by the constitutive cDNA1 promoter, and terminated trpC terminator. The *T. reesei* orotidine-5'-monophosphate (OMP) decarboxylase (pyr4 gene) is used as the selection marker in a loop-out design to facilitate recycling of the marker. The entire expression cassette is designed for targeted integration to the pmt1 locus by flanking it with homologous 5' and 3' DNA sequences. Apart from this expression cassette, pTTn160 contains the vector backbone of pTTv185.

Generation of EndoT deletion and LmSTT3 overexpression strains TR165 and *T. reesei* ManI overexpression strain TR222. Deletion of EndoT with simultaneous overexpression of LmSTT3 was performed on the basis of strain M521 (described in WO2013/174927), an 8-fold protease deletion strain which was selected for pyr4 impairment and uridine auxotrphy by using 5-fluoro-orotic acid (5-FOA). The recombination cassette of pTTn088 was prepared by digesting the vector with PmeI, separating the recombination cassette from the vector backbone on a 1% agarose gel and extracting the corresponding fragment form the gel using the illustra GFX PCR DNA and Gel Band Purification Kit (GE Healthcare). Approx. 5 µg of the purified recombination cassette was used in the transformation of M521. Preparation of protoplasts and transformation were carried out essentially according to methods in Penttila et al. (1987, Gene 61:155-164) and Gruber et al (1990, *Curr. Genet.* 18:71-76). The transformed protoplasts were plated to PD agar and let grow and sporulate. The spores were harvested as a transformant pool, filtered through cotton to obtain mononuclear cells and plated to minimal medium to allow for pyr4 selection. 48 growing colonies (transformants) were streaked to fresh minimal medium containing 1 ml/L Triton X-100 and characterized by PCR for correct integration to the EndoT locus at the 5' and 3' homology flanks and for deletion of the EndoT ORF using the primers as listed in Table 88. The primers were designed using the Clone Manager 9 Professional software (Scientific & Educational Software).

TABLE 88

Primers for PCR characterisation of pTTn088 recombination cassette integration and deletion of EndoT from M521.

| Purpose | Primer | Sequence |
| --- | --- | --- |
| Integration 5' flank | 0144 | CGTCCTCTATTCCGTTCATC (SEQ ID NO: 310) |
| | 0129 | TCCATCATTCCACGTCCTTC (SEQ ID NO: 311) |
| Integration 3' flank | 0112 | GGAGGGAAGGGAAGAAAGAAG (SEQ ID NO: 312) |
| | 0128 | TCACCCGCGAGAATTACAC (SEQ ID NO: 313) |
| EndoT ORF | 0130 | CCTCGCCTGATTGTGTACTTCC (SEQ ID NO: 314) |
| | 0132 | GCTAGGCCTCTTCACAAAGC (SEQ ID NO: 315) |

Singular integration of the recombination cassette and EndoT deletion were verified by Southern analyses. Genomic DNA for Southern analyses was extracted from 10 clones which met the PCR characterization criteria using the Wizard Genomic DNA Purification Kit (Promega) according to the manufacturer's instructions. Southern analyses were performed essentially according to the protocol for homologous hybridizations in Sambrook et al. (1989, Molecular Cloning: A laboratory manual. 2$^{nd}$ Ed., Cold Spring Harbor Laboratory Press) using Digoxigenin (DIG) labeled probes (Roche DIG Application Manual, Roche website). DIG-labelling of the probes was performed by PCR using the PCR DIG Probe Synthesis Kit (Roche) according to the manufacturer's instructions. The primers used are listed in Table 89. Genomic DNA of the *T. reesei* wild type strain QM6a (ATCC13631) served as the template. Restriction digestion schemes were designed to allow discrimination between the unmodified EndoT locus in M521 and the altered EndoT locus after replacement by the pTTn088 recombination cassette.

TABLE 89

Primers for PCR synthesis of DIG-labelled probes for Southern analysis of the EndoT locus.

| Probe target | Primer | Sequence |
| --- | --- | --- |
| EndoT 5' flank | 0142 | TGGTCAAGTCGGTAAAGC (SEQ ID NO: 316) |
| | 0143 | TCGCAACCTGACCTGAAAG (SEQ ID NO: 317) |
| EndoT 3' flank | 0139 | ATAGGCAAAGAGTATAAGGG (SEQ ID NO: 318) |
| | 0140 | TATGCTCACGACTTCTTC (SEQ ID NO: 319) |
| EndoT ORF | 0130 | CCTCGCCTGATTGTGTACTTCC (SEQ ID NO: 320) |
| | 0132 | GCTAGGCCTCTTCACAAAGC (SEQ ID NO: 321) |

In contrast to the parental strain M521, none of the clones hybridised with the EndoT ORF probe indicating successful EndoT deletion. Analyses using 5' and 3' flank specific probes revealed that all 10 clones were single integrants. Clone #01 was saved for future use and designated strain TR140. Authenticity of the pTTn088-derived sequence in TR140 was further confirmed by sequencing the entire region between both EndoT flanks.

To assess the impact of EndoT deletion and LmSTT3 overexpression on the N-glycosylation of an antibody Fc part, TR140 was transformed with the pTTn040-derived expression cassette for MAB01. The preparation of the pTTn040 fragment by PmeI digestion and gel extraction, as well as the subsequent protoplast transformation of TR140 were performed as described above.

Transformants were let recover and sporulate on selective agar containing Hygromycin B and harvested as a pool. The spore pool was filtered through cotton to obtain mononuclear cells and plated to Hygromycin B containing agar for selection. 48 growing colonies (transformants) were streaked to Hygromycin B agar containing 1 ml/L Triton X-100 and characterized by PCR for integration of the expression cassette to the cbh1 locus at the 5' and 3' homology flanks and for replacement of the parental cbh1 sequence using the primers as listed in Table 90. Assessment of the cbh1 replacement takes advantage of the fact that in the pTTn040 recombination cassette the cbh1 terminator and the cbh1 3' flank are spaced by the Hygromycin B marker (e.g. cf. Steiger M G et al. (2011) Transformation system for Hypocrea jecorina (Trichoderma reesei) that favors homologous integration and employs reusable bidirectionally selectable markers. Appl Environ Microbiol. 77:114-121. doi:10.1128/AEM.02100-10). This allows a size-based discrimination between the transformed and the wildtype cbh1 locus when priming to the cbh1 terminator and the cbh1 3' flank.

TABLE 90

Primers for PCR characterisation of pTTn040 recombination cassette integration and replacement of the parental cbh1 sequence in TR140.

| Purpose | Primer | Sequence |
| --- | --- | --- |
| Integration 5' flank | 0001 | GCTGTTCCTACAGCTCTTTC (SEQ ID NO: 322) |
|  | 0033 | AGCCGCACGGCAGC (SEQ ID NO: 323) |
| Integration 3' flank | 0056 | CCTAGTGAATGCTCCGTAAC (SEQ ID NO: 324) |
|  | 0002 | CTTCCACTTCAGGGTTGAC (SEQ ID NO: 325) |
| cbh1 parental sequence | 0058 | ACCCATAGGGAGACAAACAG (SEQ ID NO: 326) |
|  | 0020 | CTTCCACTTCAGGGTTGAC (SEQ ID NO: 327) |

Singular integration of the recombination cassette and cbh1 replacement was verified by Southern analyses using DIG-labelled probes. Genomic DNA for Southern analyses was extracted from 13 clones which met the PCR characterization criteria. DIG-labelling of the probes was performed by PCR as described above using the primers listed in Table 91.

Genomic DNA of the *T. reesei* wild type strain QM6a (ATCC13631) served as the template. Restriction digestion schemes were designed to allow discrimination between the unmodified cbh1 locus in TR140 and the altered cbh1 locus after replacement by the pTTn040 expression cassette.

TABLE 91

Primers for PCR synthesis of DIG-labelled probes for Southern analysis of the cbh1 locus.

| Probe target | Primer | Sequence |
| --- | --- | --- |
| cbh1 5' flank | 0027 | AAACGGGTAGGAATTGTCAC (SEQ ID NO: 328) |
|  | 0042 | GAATGAGTGCCTGCTACTG (SEQ ID NO: 329) |
| cbh1 3' flank | 0044 | CTCTGGATTCTCGGTTACG (SEQ ID NO: 330) |
|  | 0048 | CAGCTCTCCGACTCTTAAC (SEQ ID NO: 331) |

Analyses using the 5' and 3' flank specific probes gave the expected band pattern for all 13 transformants and the parental control, respectively, and revealed that all transformants were single integrants. Clone #02 was saved for future use and designated strain TR165. Authenticity of the pTTn040-derived antibody sequence was further confirmed by independent sequencing of the HC and LC expression cassettes.

TR165 contains a pyr4 marker in the loop-out design which was inherited from its parental strain TR140. This marker was removed from the EndoT locus using 5-FOA for counter-selection before continuation with TrMnsI overexpression and pmt1 deletion was possible. The marker removal was confirmed by assaying for uridine autotrophy and PCR using the primers listed in Table 92, which produce differently sized amplicons depending on the loop-out status.

TABLE 92

Primers for pyr4 loop-out assessment in TR174.

| Purpose | Primer | Sequence |
| --- | --- | --- |
| Pyr4 loop-out | 0056 | CCTAGTGAATGCTCCGTAAC (SEQ ID NO: 332) |
|  | 0145 | CCGCCCTTATACTCTTTG (SEQ ID NO: 333) |

The resulting pyr4 negative clone #2_1-1 was renamed to strain TR174 and served as the basis for overexpression of TrMnsI from the pmt1 locus employing the corresponding cassette from pTTn160. Vector fragment preparation and transformation were carried out as described for the creation of TR140. Transformant pools were harvested from PD plates and purified to uninuclear clones by cotton filtration and plating to minimal medium (without uridine). 48 transformants were streaked to fresh minimal medium containing 1 ml/L Triton X-100 and characterized by PCR for correct integration to the pmt1 locus at the 5' and 3' homology flanks and for deletion of the pmt1 ORF using the primers as listed in Table 93.

TABLE 93

Primers for PCR characterisation of pTTn160 recombination cassette integration and deletion of pmt1 from TR174.

| Purpose | Primer | Sequence |
|---|---|---|
| Integration 5' flank | 0085 | GGGTGAGAGGCTACCTTAAC (SEQ ID NO: 334) |
| | 0129 | TCCATCATTCCACGTCCTTC (SEQ ID NO: 335) |
| Integration 3' flank | 0112 | GGAGGGAAGGGAAGAAAGAAG (SEQ ID NO: 336) |
| | 0086 | CTTTGTCGACGACACAAAGG (SEQ ID NO: 337) |
| pmt1 ORF | 0113 | CCTCAACCCTGCAATAGTTC (SEQ ID NO: 338) |
| | 0114 | GTCGCACCAAGTCTTGATTC (SEQ ID NO: 339) |

Singular integration of the recombination cassette and pmt1 deletion was verified by Southern analyses. Genomic DNA for Southern analyses was extracted from 6 clones which met the PCR characterization criteria. DIG-labelling of the probes was performed by PCR as described above using the primers listed in Table 94. Genomic DNA of the *T. reesei* wild type strain QM6a (ATCC13631) served as the template. Restriction digestion schemes were designed to allow discrimination between the unmodified pmt1 locus in TR174 and the altered pmt1 locus after replacement by the pTTn160 recombination cassette.

TABLE 94

Primers for PCR synthesis of DIG-labelled probes for Southern analysis of the pmt1 locus.

| Probe target | Primer | Sequence |
|---|---|---|
| pmt1 5' flank | 0097 | GGGCGTACAGAACTGTTG (SEQ ID NO: 340) |
| | 0098 | GTCGTTGAAGGCTGAGAC (SEQ ID NO: 341) |
| pmt1 3' flank | 0099 | GATGATGACAGCCAGAAGG (SEQ ID NO: 342) |
| | 0100 | CTCCCGCTCTCGTATATG (SEQ ID NO: 343) |

TABLE 94-continued

Primers for PCR synthesis of DIG-labelled probes for Southern analysis of the pmt1 locus.

| Probe target | Primer | Sequence |
|---|---|---|
| pmt1 ORF | 0091 | CAACAACTACTGGCAGATCC (SEQ ID NO: 344) |
| | 0092 | GACCTCTGCAGCTCAAAC (SEQ ID NO: 345) |

In contrast to the parental strain TR174, none of the 6 clones hybridised with the pmt1 ORF probe indicating successful deletion of pmt1. Analyses using 5' and 3' flank specific probes revealed that at least 4 of the 6 clones were single integrants. Clone #01 was saved for future use and designated strain TR222. Authenticity of the pTTn160-derived sequence in TR222 was further confirmed by sequencing the entire region between both pmt1 flanks. The history of this strain is summarized in Table 95.

TABLE 95

Generation of strain TR222.

| Strain | Parental strain | Vector | Clone # | Locus | Markers | Deletion | Over expression |
|---|---|---|---|---|---|---|---|
| TR140 | M521 | pTTn088 | 01 | EndoT (TrelD65162) | pyr4 | EndoT (TrelD65162) | LmSTT3 |
| TR165 | TR140 | pTTn040 | 02 | cbhl | Hyg (pyr4) | — | MAB01 |
| TR174 | TR165 | none (pyr4 loop-out) | 02_1-1 | — | Hyg | — | — |
| TR222 | TR174 | pTTn160 | 01 | pmt1 | Hyg (pyr4) | pmt1 | TrManI |

Fermentation. TR222 was fermented in 2% YE, 12% cellulose and also in 4% WSG, 2% Glc, 4% cellobiose, 6% Lac. TR252 was fermented in 2% YE, 12% cellulose, 2% glucose with Glucose/Sorbose feed. Sampling was performed at days 3-6. N-glycans were analysed as described above.

Antibody purification. Antibody was purified from the supernatant samples using Protein G HP MultiTrap 96-well filter plate (GE Healthcare) according to manufacturer's instructions. The antibody concentrations were determined via UV absorbance against MAB01 standard curve. The titers of TR222 in WSG increased with time from 0.688 to 2.66 g/l. Titers of TR252 increased from 0.368 to 2.25 g/l (day 3 to day 6).

Figure 23:
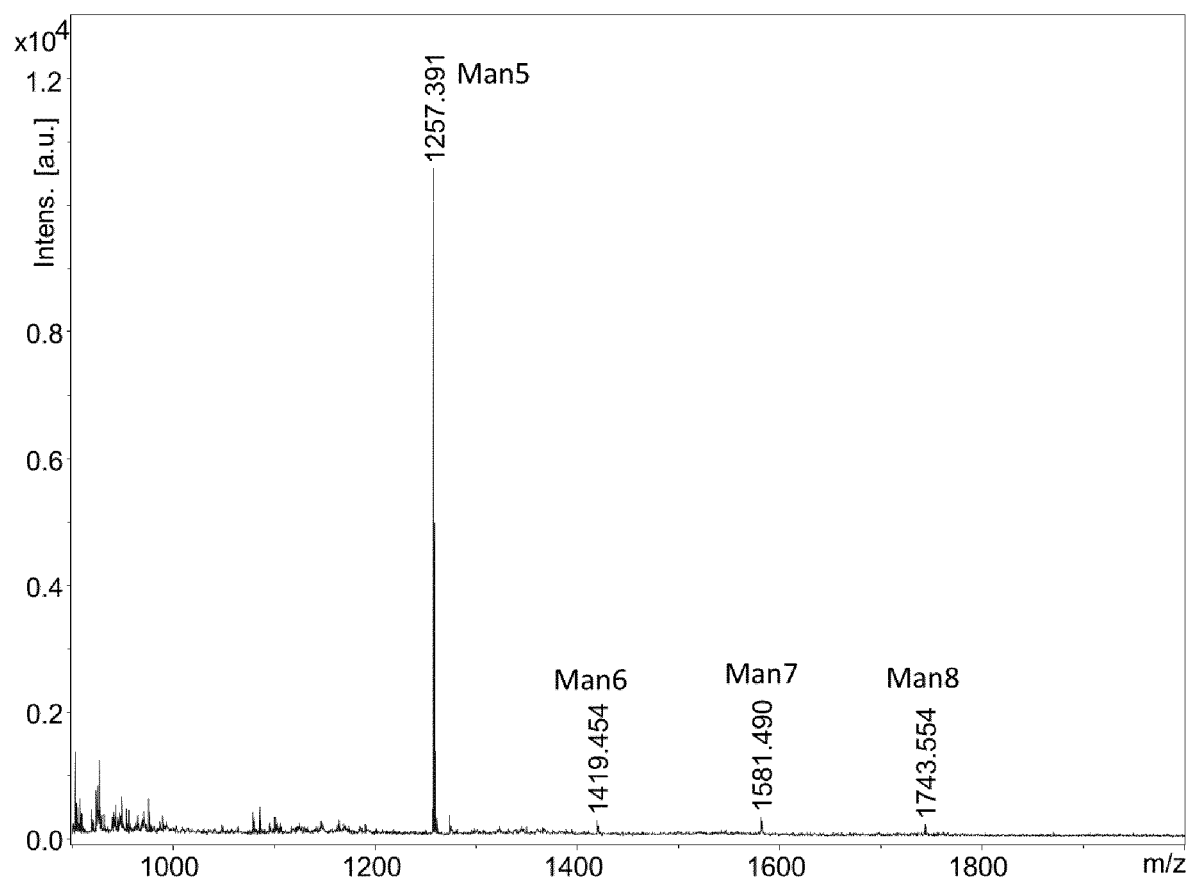
FIG. 23 depicts MALDI-TOF MS image of neutral N-glycans released from antibody from strain TR222 fermented in for 5 days in WSG.
Figure 24:
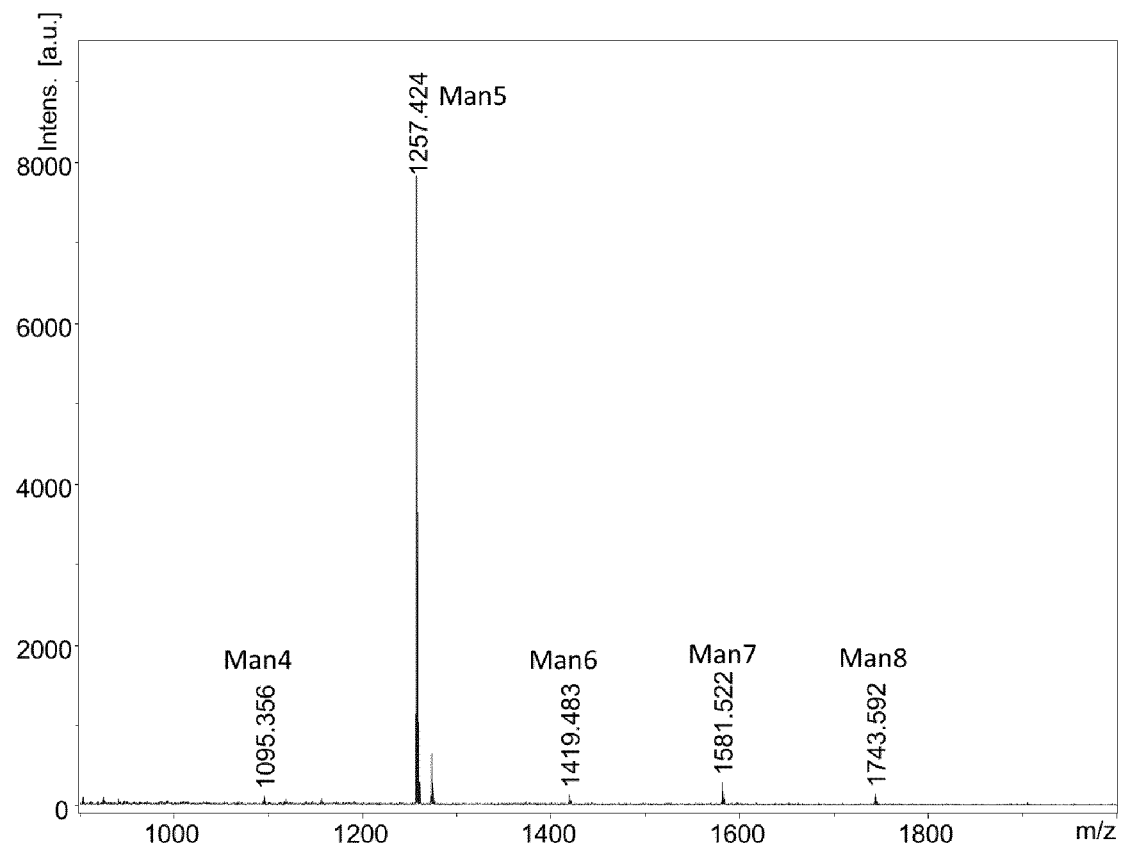
FIG. 24 depicts MALDI-TOF MS image of neutral N-glycans released from antibody from strain TR222 fermented in for 3 days in YE.

N-Glycan analysis of TR222. N-glycans of TR222 were detached from equal volumes (15 µl) of purified antibody. N-glycans from TR252 were detached from 20 µg purified antibody. The PNGase F reactions were carried out as described in WO2013/102674. The released neutral N-glycans were purified with Hypersep C18 and Hypersep Hypercarb (Thermo Scientific) and analysed with MALDI-TOF MS. FIGS. 23 and 23 show MALDI-TOF TR222 images of the neutral N-glycans on antibody at day 5 fermented in WSG and in YE, respectively. Results are shown in Tables 96 and 97 and TR252 in Table 98.

TABLE 96

Relative proportions (%) of the predominant neutral N-glycans from purified MAB01 antibody from strain TR222 fermented in WSG medium.

| | Man4 | Man5 | Hex6 | Hex7 | Hex8 |
|---|---|---|---|---|---|
| Day 3 | 1.6 | 91.8 | 2.3 | 2.9 | 1.3 |
| Day 4 | 2.3 | 91.5 | 1.7 | 2.8 | 1.6 |
| Day 5 | 0.0 | 92.4 | 2.5 | 3.0 | 2.0 |
| Day 6 | 1.9 | 91.1 | 2.2 | 2.7 | 2.0 |

TABLE 97

Relative proportions (%) of the predominant neutral N-glycans from purified MAB01 antibody from strain TR222 fermented in YE medium.

| | Man4 | Man5 | Man6 | Man7 | Man8 | Man9 |
|---|---|---|---|---|---|---|
| Day 3 | 1.4 | 91.6 | 1.7 | 3.5 | 1.7 | 0.0 |
| Day 4 | 1.2 | 91.6 | 1.8 | 3.1 | 2.3 | 0.0 |
| Day 5 | 2.3 | 88.1 | 2.5 | 3.4 | 2.8 | 0.9 |
| Day 6 | 1.7 | 86.4 | 3.4 | 4.0 | 3.8 | 0.6 |

TABLE 98

Relative proportions (%) of the predominant neutral N-glycans from purified MAB01 antibody from strain TR252 fermented in YE medium with Glc/Sorbose feed.

| | Man4 | Man5 | Man6 | Man7 | Man8 | Man9 |
|---|---|---|---|---|---|---|
| Day 3 | 2.4 | 93.6 | 2.2 | 1.1 | 0.7 | 0.0 |
| Day 4 | 2.1 | 89.7 | 4.2 | 2.3 | 1.7 | 0.0 |
| Day 5 | 1.0 | 87.9 | 6.4 | 2.7 | 1.8 | 0.2 |
| Day 6 | 0.0 | 86.7 | 7.3 | 3.5 | 2.4 | 0.0 |

Figure 25:
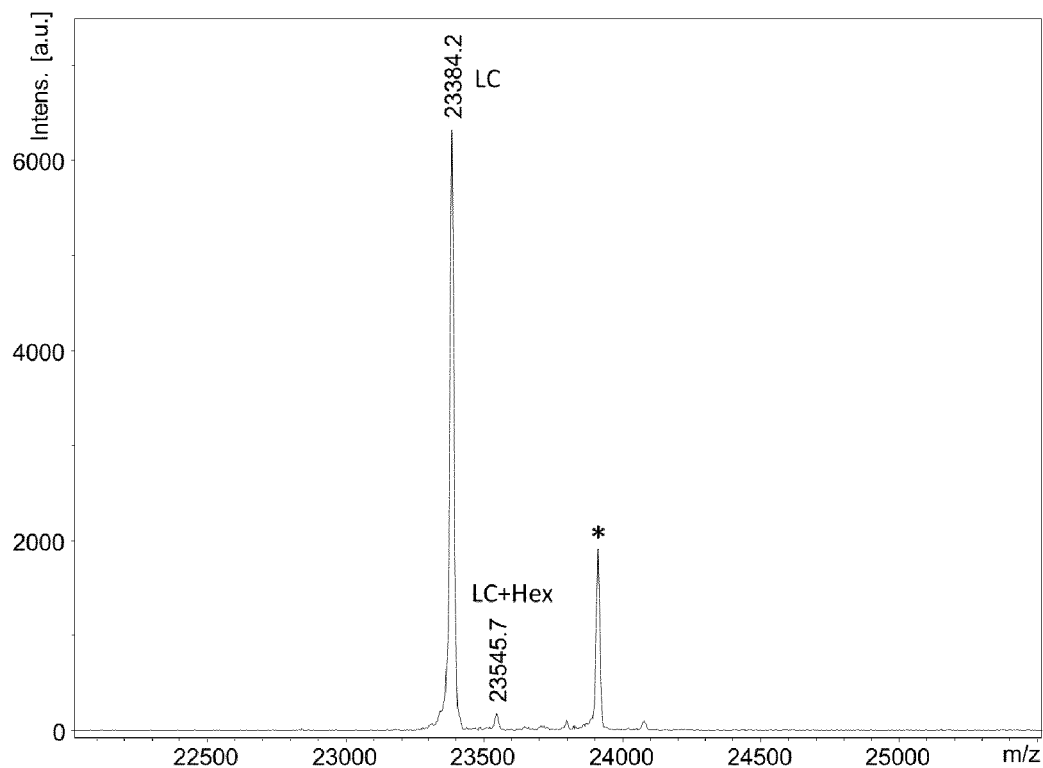
FIG. 25 depicts MALDI-TOF MS image of O-glycosylation on light chains of MAB01 from TR222. Fermentation in YE, day 3. Unknown signal is marked with asterisk.
Figure 26:
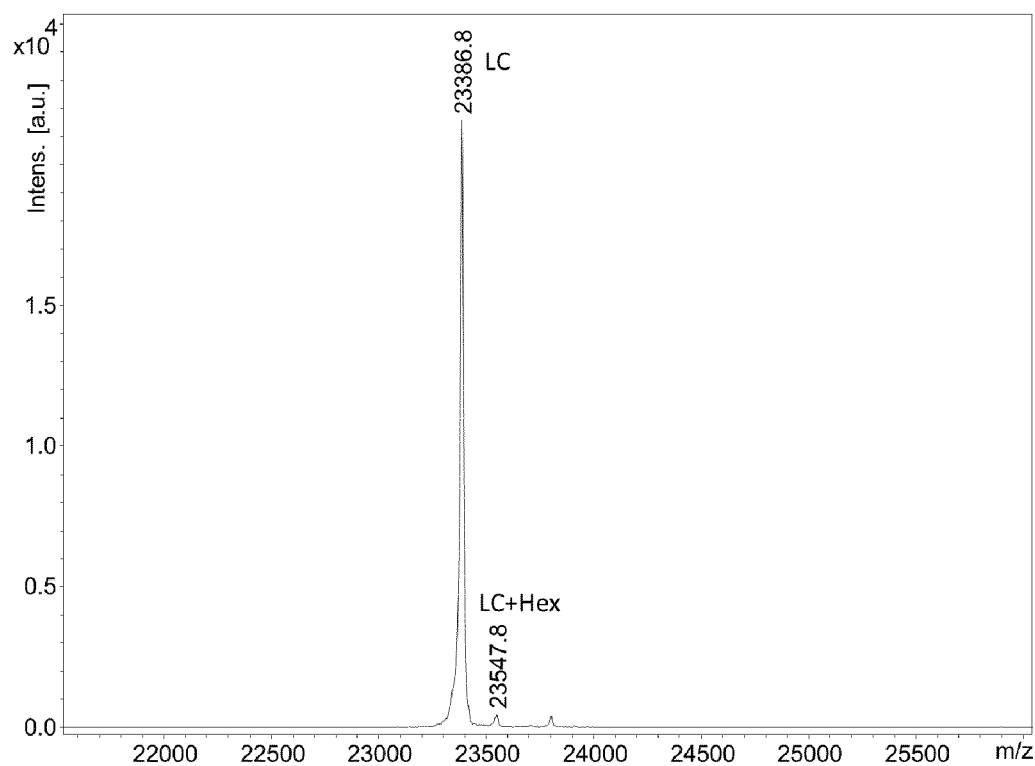
FIG. 26 depicts MALDI-TOF MS image of O-glycosylation on light chains of MAB01 from TR222. Fermentation in WSG, day 6. Unknown signal is marked with asterisk.

O-Glycan analysis of TR222. For O-mannosylation analysis, 30 µg of purified antibody was incubated in 6 M Guanidinium HCl for 30 minutes at +60° C. after which 5 µl of fresh 0.1 M DTT was added and incubated again as above. The samples were purified using Poros R1 96-well plate and the resulting light chains were analysed using MALDI-TOF MS. FIGS. 25 and 26 show MALDI-TOF images of the O-glycosylation on antibody light chains at day 5 fermented in WSG and in YE, respectively.

Site occupancy analysis. 30 µg of purified antibody was taken to site occupancy analysis. Antibodies were digested with FabRICATOR enzyme (Genovis) and purified using Poros R1 96-well filterplate (Glygen corp.) as described above. The Fc fragments were analysed using MALDI-TOF MS. Site occupancy analysis results are shown in Table 99. LmSTT3 has increased the site occupancy close to 100%. With deletion of Endo T activity by adding LmSTT3 to strain TR252, the site occupancy has increased close to 100% and the product of Endo T (Fc+Gn) has decreased to 0% (Table 100). M887 without LmSTT3 shows lower site occupancy and high Endo T activity.

TABLE 99

Relative proportions (%) of glycosylated Fc-fractions of purified antibody from strain TR222 fermented in WSG and YE media.

| | Site occupancy | |
|---|---|---|
| Day | WSG | YE |
| 3 | 95.5 | 95.8 |
| 4 | 97.5 | 96.8 |

TABLE 99-continued

Relative proportions (%) of glycosylated Fc-fractions of purified antibody from strain TR222 fermented in WSG and YE media.

| | Site occupancy | |
|---|---|---|
| Day | WSG | YE |
| 5 | 97.4 | 97.2 |
| 6 | 99.1 | 97.0 |

TABLE 100

Relative proportions (%) of different Fc-fractions of purified antibody from strains TR252 and M887 fermented in YE medium with Glc/Sorbose feed.

| | TR252 | | | M887 | | |
|---|---|---|---|---|---|---|
| | Fc | Fc + Gn | Glycosylated | Fc | Fc + Gn | Glycosylated |
| Day 3 | 0.4 | | 99.6 | 39.1 | 2.9 | 58.1 |
| Day 4 | | | 100.0 | 35.3 | 4.0 | 60.7 |
| Day 5 | 0.9 | | 99.1 | 25.6 | 15.0 | 59.4 |

Example 16

Generation of Strains Producing Low Levels of Hex6

Any of the strains producing high levels of Hex6 may be transformed with vectors described above for *T. reesei, T. congolense,* and/or *A. niger* constructs for glucosidase 2 alpha and/or beta subunits. In certain embodiments, resulting *Trichoderma* strain can over express two glucosidase II from different species or over express *Trichoderma*'s endogenous glucosidase 2 (with or without ER targeting peptide HDEL) and a exogenous glucosidase 2, such as *T. congolense* Gls IIα.

In some embodiments, the strain may be transformed with a construct deleting the alg3 locus.

Example 17

Generation of ManII Strains M1056, M1112-M1115 and M1150-M1155

This example describe the generation of *T. reesei* strains having the following characteristics:
it comprises GnTI, GnTII and Mannosidase II recombinant genes.
The best resulting strains is producing 71% of GlcNAc2Man3 glycoform and 26.1% of G0 glycoform.

All but one of the six plasmids contain a common Golgi targeting signal; 85 amino acids from *T. reesei* KRE2 (tre21576). The targeting signal is followed by ManII gene with N-terminal truncation. Vector pTTg229 contain full length Culex quinquefasciatus ManII with its own native localization signal. The origins of ManII genes and the lengths of N-terminal truncations are listed in Table 101. The genes are expressed under the control of pcDNA1 promoter and followed by egl2 terminator. The expression cassette of ManII gene is followed by human GnTII gene, which is expressed under the control of gpdA promoter and trpC terminator. Expression cassettes are targeted to egl1 locus (tre122081) and contain pyr4-hygR double selection cassette with a loop-out sequence for marker removal. ManII genes are synthetic genes.

A backbone vector containing pRS426 backbone, egl1 (tre122081) 5' and 3'flanking regions for targeted integration to the *T. reesei* genome, expression cassettes for *Drosophila melanogaster* ManII and human GnTII, pyr4-hyg$^R$ double selection cassette and pyr4 loop-out sequence for marker removal was first created. Full-length ManII was PCR amplified from a synthetic vector with primers that created PacI and AflII sites to the 5'- and 3'-ends of the gene, respectively. Another plasmid containing the flanking regions, cDNA1 promoter, human ManII, egl2 terminator, gpdA promoter, human GnTII, trpC terminator, pyr4-hyg$^R$ double selection cassette and pyr4 loop-out sequence, was digested with FspAI and BstEII, and the 16.4 kb backbone fragment was gel-purified. The missing fragments (part of egl1 5'flank+pcDNA1 and egl2 terminator+part of gpdA promoter) were PCR amplified from the intact plasmid with flanks to the adjacent fragments. The four cloning fragments were then joined by yeast homologous recombination as described in PCT/EP2013/050126. A few clones were selected, plasmid DNAs isolated and sequenced. One clone was selected and stored.

To clone vector pTTg229, full length Culex quinquefasciatus ManII synthetic gene was PCR ampilied with primers that created PacI and AflII sites to the 5'- and 3'-ends of the gene, respectively. Both the PCR fragment and the backbone vector were cut with PacI and AflII, the ManII fragment (3.4 kb) and the vector backbone (18.3 kb) were gel-purified and finally ligated. A few clones were selected, plasmid DNAs isolated and sequenced. One clone was selected and stored.

The ManII genes for pTTg223, pTTg224, pTTg225, pTTg227, and pTTg234 (see Table 101) were PCR amplified from synthetic genes with primers that in each case created a truncated mannosidase gene with flanks to the adjacent fragments. Other fragments needed were also PCR amplified. Kre2 fragment was PCR amplified from pTTv142, human mannosidase was PCR amplified from a plasmid having human full-length ManII and other fragments (part of egl1 5'flank+pcDNA1 and egl2 terminator+part of gpdA promoter) were PCR amplified from the intact backbone vector. The vector was digested with AvrII and FspAI, and the 15 kb fragment was gel-purified. The four cloning fragments were then joined by yeast homologous recombination as described in PCT/EP2013/050126. A few clones were selected for each construct, plasmid DNAs isolated and sequenced. One clone for each construct was selected and stored.

TABLE 101

Outline of five ManII expression constructs with native or KRE2 (tre21576) Golgi targeting signal. N-terminal truncations of the ManII proteins are indicated.

| Mold strain | Vector | Targeting | Origin of ManII, Δaa from N-terminus |
|---|---|---|---|
| M1056 | pTTg229 | Native *C. quinquefasciatus* ManII | *Culex quinquefasciatus* ManII full length |
| M1112 | pTTg223 | Kre2 (tre21576) 85 aa | *Drosophila melanogaster* ManII, Δ74 aa |
| M1113 | pTTg223 | Kre2 (tre21576) 85 aa | *Drosophila melanogaster* ManII, Δ74 aa |
| M1114 | pTTg227 | Kre2 (tre21576) 85 aa | *Mus musculus* ManII, Δ74 aa |
| M1115 | pTTg227 | Kre2 (tre21576) 85 aa | *Mus musculus* ManII, Δ74 aa |
| M1150 | pTTg234 | Kre2 (tre21576) 85 aa | *Homo sapiens* ManII, Δ74 aa |
| M1151 | pTTg234 | Kre2 (tre21576) 85 aa | *Homo sapiens* ManII, Δ74 aa |
| M1152 | pTTg224 | Kre2 (tre21576) 85 aa | *Culex quinquefasciatus* ManII, Δ74 aa |
| M1153 | pTTg224 | Kre2 (tre21576) 85 aa | *Culex quinquefasciatus* ManII, Δ74 aa |
| M1154 | pTTg225 | Kre2 (tre21576) 85 aa | *Caenorhabditis remanei* ManII, Δ108 aa |
| M1155 | pTTg225 | Kre2 (tre21576) 85 aa | *Caenorhabditis remanei* ManII, Δ108 aa |

Shake flask. *T. reesei* clones expressing native *Culex quinquefasciatus* ManII (pTTg229, clone #2=M1056), *Drosophila melanogaster* ManII (pTTg223, clones #29-4 [M1112], #73-4 [M1113]), *Mus musculus* ManII (pTTg227, clones #32-4 [M1114], #32-5 [M1115]), *Culex quinquefasciatus* ManII with Kre2 targeting (pTTg224, clones #66-6, #70-5 [M1152], #71-4 [M1153]) and *Caenorhabditis remanei* ManII (pTTg225, clones #50-15 [M1154], #50-18 [M1155]) were cultured in shake flask in TrMM with 40 g/l lactose, 20 g/l spent grain extract and 100 mM PIPPS, pH 5.5. N-glycans were analysed as described above from day 5 samples. Results are shown in Table 102.

TABLE 102

Relative proportions of neutral N-glycans from purified MAB01 antibody from ManII expressing clones grown in shake flasks.

| Composition | Short | Clone m\z | pTTg229 #2 % | pTTg223 #29-4 % | pTTg223 #73-4 % | pTTg227 #32-4 % | pTTg227 #32-5 % | pTTg224 #66-6 % | pTTg224 #70-5 % | pTTg224 #71-4 % | pTTg225 #50-15 % | pTTg225 #50-18 % |
|---|---|---|---|---|---|---|---|---|---|---|---|---|
| Hex3HexNAc3 | GnMan3 | 1136.40 | 45.9 | 8.3 | 2.1 | 0.0 | 0.0 | 62.6 | 61.2 | 71.0 | 30.8 | 35.9 |
| Hex5HexNAc2 | Man5 | 1257.42 | 21.4 | 4.1 | 8.1 | 5.4 | 7.4 | 6.2 | 5.9 | 5.1 | 17.4 | 14.8 |
| Hex4HexNAc3 | GnMan4 | 1298.45 | 3.8 | 7.6 | 4.9 | 0.9 | 0.8 | 5.9 | 6.0 | 5.4 | 1.6 | 1.4 |
| Hex3HexNAc4 | G0 | 1339.48 | 8.4 | 1.2 | 0.8 | 0.4 | 0.5 | 6.6 | 13.8 | 8.0 | 26.1 | 25.3 |
| Hex6HexNAc2 | Man6 | 1419.48 | 6.3 | 3.3 | 4.4 | 3.8 | 4.6 | 3.5 | 5.0 | 2.9 | 11.5 | 10.3 |
| Hex5HexNAc3 | GnMan5 | 1460.50 | 5.3 | 68.2 | 71.3 | 82.4 | 78.4 | 10.7 | 8.0 | 5.5 | 1.7 | 2.0 |
| Hex7HexNAc2 | Man7 | 1581.53 | 5.1 | 3.0 | 3.8 | 3.2 | 3.9 | 2.3 | 0.0 | 2.0 | 6.9 | 6.5 |
| Hex6HexNAc3 | GnMan6 | 1622.56 | 0.0 | 0.8 | 0.7 | 0.6 | 0.7 | 0.8 | 0.0 | 0.0 | 0.0 | 0.0 |
| Hex8HexNAc2 | Man8 | 1743.58 | 2.9 | 2.1 | 2.7 | 2.2 | 2.3 | 1.3 | 0.0 | 0.0 | 3.0 | 3.1 |
| Hex9HexNAc2 | Man9 | 1905.63 | 0.9 | 0.6 | 0.6 | 0.7 | 1.0 | 0.0 | 0.0 | 0.0 | 1.0 | 0.7 |
| Hex10HexNAc2 | Man10 | 2067.69 | 0.0 | 0.0 | 0.2 | 0.0 | 0.0 | 0.0 | 0.0 | 0.0 | 0.0 | 0.0 |

Fermentation and glycan analysis of M1056 and M1152-M1153. *T. reesei* strain M1056 with native targeted mannosidase II from *Culex quinquefasciatus* was fermented in 4% WSG, 2% Glc, 4% cellobiose, 6% Lac. Sampling was performed at days 3-6. Titers increased with time from 0.32 to 0.75 g/l. N-glycans were analysed as described above. Results are shown in Table 103. Mannosidase II from *Culex quinquefasciatus* has cleaved all of GnMan5. G0 level was 23% at highest.

TABLE 103

Relative proportions of neutral N-glycans from purified antibody from strain M1056 fermented in WSG medium.

| Composition | Short | m\z | d3 % | d4 % | d5 % | d6 % |
|---|---|---|---|---|---|---|
| Man3 | H3N2 | 933.31 | 0.0 | 0.0 | 0.0 | 0.0 |
| Man4 | H4N2 | 1095.37 | 0.0 | 0.0 | 0.0 | 1.3 |
| GnMan3 | H3N3 | 1136.40 | 22.1 | 33.0 | 33.3 | 35.7 |
| Man5 | H5N2 | 1257.42 | 20.9 | 25.9 | 23.8 | 25.2 |
| G0 | H3N4 | 1339.48 | 23.1 | 16.5 | 22.5 | 21.5 |

TABLE 103-continued

Relative proportions of neutral N-glycans from purified antibody from strain M1056 fermented in WSG medium.

| Composition | Short | m\z | d3 % | d4 % | d5 % | d6 % |
|---|---|---|---|---|---|---|
| Man6 | H6N2 | 1419.48 | 13.4 | 11.2 | 9.8 | 7.6 |
| GnMan5 | H5N3 | 1460.50 | 1.6 | 0.0 | 0.0 | 0.0 |
| Man7 | H7N2 | 1581.53 | 11.7 | 8.7 | 6.3 | 5.0 |
| Man8 | H8N2 | 1743.58 | 5.8 | 3.9 | 3.4 | 3.0 |
| Man9 | H9N2 | 1905.63 | 1.3 | 0.9 | 0.9 | 0.7 |

*T. reesei* strains M1152 and M1153 with Kre2 targeted mannosidase II from *Culex quinquefasciatus* was fermented in 4% WSG, 2% glucose, 4% cellobiose, 6% lactose. Sampling was performed at days 3-6. Titer increased over time from 0.471 to 1.139 g/l (M1152) and from 0.425 to 1.075 g/l (M1153). N-glycans were analysed as described above. Results are shown in Table 104. *Culex quinquefasciatus* ManII with Kre2 targeting has cleaved all of the GnMan5 at days 5-6.

TABLE 104

Relative proportions of neutral N-glycans from purified MAB01 antibody from strains M1152 and M1153 fermented in WSG medium.

| | | | M1152 | | | | M1153 | | | |
|---|---|---|---|---|---|---|---|---|---|---|
| Composition | Short | m\z | d3 % | d4 % | d5 % | d6 % | d3 % | d4 % | d5 % | d6 % |
| Hex3HexNAc3 | GnMan3 | 1136.40 | 40.6 | 57.4 | 60.9 | 67.3 | 42.4 | 59.5 | 63.0 | 66.7 |
| Hex5HexNAc2 | Man5 | 1257.42 | 16.1 | 16.7 | 15.5 | 17.6 | 13.3 | 10.6 | 11.5 | 18.9 |
| Hex4HexNAc3 | GnMan4 | 1298.45 | 3.0 | 0.6 | 0.0 | 0.0 | 2.8 | 1.0 | 0.0 | 0.4 |
| Hex3HexNAc4 | G0 | 1339.48 | 10.3 | 9.9 | 10.7 | 7.1 | 13.1 | 13.8 | 13.3 | 6.2 |
| Hex6HexNAc2 | Man6 | 1419.48 | 11.5 | 7.4 | 6.4 | 3.3 | 10.6 | 6.4 | 5.4 | 4.0 |
| Hex5HexNAc3 | GnMan5 | 1460.50 | 2.9 | 0.7 | 0.0 | 0.0 | 3.1 | 0.9 | 0.0 | 0.0 |
| Hex7HexNAc2 | Man7 | 1581.53 | 9.3 | 4.7 | 4.2 | 3.1 | 9.2 | 4.6 | 4.3 | 2.4 |
| Hex6HexNAc3 | GnMan6 | 1622.56 | 0.8 | 0.3 | 0.0 | 0.0 | 0.8 | 0.0 | 0.3 | 0.0 |
| Hex8HexNAc2 | Man8 | 1743.58 | 4.3 | 1.9 | 2.4 | 1.5 | 3.7 | 2.4 | 1.9 | 1.5 |
| Hex9HexNAc2 | Man9 | 1905.63 | 1.1 | 0.5 | 0.0 | 0.0 | 0.8 | 0.8 | 0.4 | 0.0 |
| Hex10HexNAc2 | Man10 | 2067.69 | 0.0 | 0.0 | 0.0 | 0.0 | 0.2 | 0.0 | 0.0 | 0.0 |

*T. reesei* strains M1154 and M1155 with mannosidase II from *Caenorhabditis remanei* was fermented in 4% WSG, 2% glucose, 4% cellobiose, 6% lactose. Sampling was performed at days 3-6. Titer increased over time from 0.446 to 1.068 g/l (M1154) and from 0.592 to 1.027 g/l (M1155). N-glycans were analysed as described above. Results are shown in Table 105. *Caenorhabditis remanei* ManII has cleaved all of the GnMan5.

TABLE 105

Relative proportions of neutral N-glycans from purified MAB01 antibody from strains M1154 and M1155 fermented in WSG medium.

| | | | M1154 | | | | M1155 | | | |
|---|---|---|---|---|---|---|---|---|---|---|
| Composition | Short | m\z | d3 % | d4 % | d5 % | d6 % | d3 % | d4 % | d5 % | d6 % |
| Hex3HexNAc3 | GnMan3 | 1136.40 | 33.9 | 48.3 | 54.5 | 53.7 | 35.3 | 42.5 | 48.3 | 48.7 |
| Hex5HexNAc2 | Man5 | 1257.42 | 10.2 | 11.4 | 11.4 | 9.0 | 16.9 | 15.5 | 16.5 | 17.1 |
| Hex4HexNAc3 | GnMan4 | 1298.45 | 0.0 | 0.5 | 0.0 | 0.0 | 0.3 | 0.0 | 0.0 | 0.0 |
| Hex3HexNAc4 | G0 | 1339.48 | 25.7 | 20.3 | 18.6 | 24.7 | 21.8 | 22.9 | 17.3 | 16.9 |
| Hex6HexNAc2 | Man6 | 1419.48 | 11.3 | 9.0 | 7.4 | 5.9 | 11.7 | 8.4 | 9.2 | 8.9 |
| Hex5HexNAc3 | GnMan5 | 1460.50 | 1.3 | 0.0 | 0.0 | 0.0 | 0.0 | 0.0 | 0.0 | 0.0 |
| Hex7HexNAc2 | Man7 | 1581.53 | 11.9 | 6.7 | 5.5 | 4.4 | 9.3 | 6.9 | 5.3 | 5.6 |
| Hex6HexNAc3 | GnMan6 | 1622.56 | 0.0 | 0.2 | 0.0 | 0.0 | 0.0 | 0.0 | 0.0 | 0.0 |
| Hex8HexNAc2 | Man8 | 1743.58 | 4.4 | 2.9 | 2.2 | 2.3 | 3.8 | 3.1 | 2.6 | 2.3 |

TABLE 105-continued

Relative proportions of neutral N-glycans from purified MAB01 antibody from strains M1154 and M1155 fermented in WSG medium.

| | | | M1154 | | | | M1155 | | | |
|---|---|---|---|---|---|---|---|---|---|---|
| | | | d3 | d4 | d5 | d6 | d3 | d4 | d5 | d6 |
| Composition | Short | m\z | % | % | % | % | % | % | % | % |
| Hex9HexNAc2 | Man9 | 1905.63 | 1.3 | 0.5 | 0.4 | 0.0 | 0.7 | 0.7 | 0.7 | 0.5 |
| Hex10HexNAc2 | Man10 | 2067.69 | 0.0 | 0.2 | 0.0 | 0.0 | 0.2 | 0.0 | 0.0 | 0.0 |

Example 18

Using CRISPR-CAS System to Generate Gene Deficient Strains of *T. reesei*

Cas9 nuclease sequence with C-terminally tagged nuclear localization signal (nls) is codon optimized for expression in *Trichoderma reesei*. Sequence is cloned under the control of constitutive gpdA promoter and trpC terminator sequences, using basic cloning vector and standard procedures. Final Cas9 nuclease expression vector is constructed from following components: pep4 protease (or any other suitable protease) locus 5' flanking sequence+pgpdA-Cas9-nls-ttrpC cassette+pyr4-hyg$^R$ double selection cassette and pyr4 loop-out sequence+pep4 protease locus 3' flanking sequence. Vector is constructed to pRS426 backbone by utilizing yeast recombination methodology; overlaps between the vector components are generated with PCR primers. Cas9 nuclease expression vector is transformed with peg-mediated protoplast transformation method to wild-type *T. reesei* M124 strain or any other *T. reesei* strain generated above or in WO/2013/174927 or WO/2013/102674, generating simultaneously pep4 protease deletion. Generated strain Cas9_M124 is then used as a background strain for transfection of transient gRNA cassettes generated by PCR, as described in DiCarlo et al. 2013 (Genome engineering in *Saccharomyces cerevisiae* using CRISPR-Cas systems; NAR 41:4336-4343) or Arazoef et al. Tailor-made CRISPR/Cas system for highly efficient targeted gene replacement in the rice blast fungus. Biotechnol Bioeng. 2015 Jun. 3. doi: 10.1002/bit.25662. Alternatively, RNA polymerase III SNR52 promoter- and SUP4 3' flanking region from *Saccharomyces* are replaced with *Trichoderma* homologues. Guide RNA needed for precise genomic targeting of CAS9 nuclease is located between the promoter and 3' flanking region. Guide RNA is composed of 20 nt's long sequence complementary to desired genomic target, followed by 3 nt's complementary with NGG PAM (protospacer-adjacent motif)—sequence and constant 3' portion required for CAS9 activity. The genomic targets are selected among hydrolytic enzymes or enzymes from glycan biosynthesis pathway of *Trichoderma reesei*. Transient guide RNA cassettes (single and multiple) are introduced to Cas9_ M124 protoplasts by electroporation or by other basic gene transfer method. Protease deficient clones are selected on the basis of reduced protease activity, caused by CAS9-generated point mutations to desired genomic target sequences. Clones with point mutations targeted to glycan biosynthesis pathway can be selected by glycan profiling. After single spore purification, selected clones are characterized by PCR amplification of genomic target locus and sequencing of the PCR product, to verify the point mutation inactivating the gene.

Alternative way to produce guide RNA is to express the sequence or multiple sequences from promoter transcribed by RNA polymerase II and flank the guide RNA's with self-processing ribozyme sequences, as described in Gao and Zhao 2014 (Self-processing of ribozyme flanked RNA's into guide RNA's in vitro and in vivo for CRISPR mediated genome editing; Journal of Integrative plant biology, 56:343-349).

TABLE 106

Guide RNA sequences targeted to *T. reesei* proteases and glycoenzymes.

| Enzyme | id | Guide RNA sequence |
|---|---|---|
| pep1 | 74156 | CCCCACCGAGGGTCAGAAGA (SEQ ID NO: 346) |
| pep2 | 53961 | CACCGTCCTGTCTGCCTCCA (SEQ ID NO: 347) |
| pep3 | 121133 | TCCAGGCCCAGGCAAAGTTC (SEQ ID NO: 348) |
| pep4 | 77579 | GTTCAACGACAAGCCGCCCA (SEQ ID NO: 349) |
| pep5 | 81004 | GCATGCCATTGAGATCAACC (SEQ ID NO: 350) |
| pep7 | 58669 | CCACGCGCGGCGCCCCAAGC (SEQ ID NO: 351) |
| pep8 | 122076 | ATTACGTTGCAGCTCGACAC (SEQ ID NO: 352) |
| pep11 | 121306 | CACCACCTTTGTCGACGCCA (SEQ ID NO: 353) |
| pep12 | 119876 | GACGCCATCAATAACCTCAC (SEQ ID NO: 354) |
| pep9 | 79807 | CCCGATGCGCCCAACACCGC (SEQ ID NO: 355) |
| tsp1 | 73897 | TCGCAGATCCGCGTCCGCGC (SEQ ID NO: 356) |
| slp | 57433 | ATCTATCTAAGCATTTCGCA (SEQ ID NO: 357) |
| slp | 35726 | GCTGCCCCTGATGCGACTAT (SEQ ID NO: 358) |
| slp | 60791 | GTCGACCAACTCCATACTCA (SEQ ID NO: 359) |
| slp | 109276 | AACGACACCGACATCTTCTA (SEQ ID NO: 360) |
| slp1 | 51365 | CGCGTACATCTTCGAATTCG (SEQ ID NO: 361) |
| slp2 | 123244 | CTGAAGCACACTTTCAAGAT (SEQ ID NO: 362) |
| slp3 | 123234 | CTTGTTCCCACTACCAAGCA (SEQ ID NO: 363) |
| slp5 | 64719 | ACTCCTTCAGCATGCACACC (SEQ ID NO: 364) |
| slp6 | 121495 | AGAAACCGTTAAGCAGATCA (SEQ ID NO: 365) |
| slp8 | 58698 | AACAAGAACAGCACGTTCGA (SEQ ID NO: 366) |
| gap1 | 69555 | GTGATGGCACCTACGATGCC (SEQ ID NO: 367) |
| gap2 | 106661 | GTGCTGCCCGCCGCTCCAAC (SEQ ID NO: 368) |
| gap3 | 70927 | GTCATTGATTCGCCCCCAGA (SEQ ID NO: 369) |
| gap4 | 57575 | CGCGAATTCCCCTCAGACTC (SEQ ID NO: 370) |
| amp1 | 81070 | GAGCTTCTACAAGTTCGCAA (SEQ ID NO: 371) |

TABLE 106-continued

Guide RNA sequences targeted to T. reesei proteases and glycoenzymes.

| Enzyme | id | Guide RNA sequence | |
|---|---|---|---|
| amp2 | 108592 | CCTCGACTCGCGCTTCGTCA | (SEQ ID NO: 372) |
| sep1 | 124051 | GCAGCCAGCACTCCCACCTA | (SEQ ID NO: 373) |
| slp7 | 123865 | TCTCCGACCCCTCAAGCCCA | (SEQ ID NO: 374) |
| tpp1/sed3 | 82623 | GCAGTTCTGCCGTCGAGTCT | (SEQ ID NO: 375) |
| sed2 | 70962 | GAGATACCAGCAACGCGCGA | (SEQ ID NO: 376) |
| sed5 | 111838 | GATCCTTCATCAGAAACATT | (SEQ ID NO: 377) |
| sed3 | 81517 | GCAGCCATATATCGACAGCC | (SEQ ID NO: 378) |
| mp1 | 122703 | CAGACGACGACGCTCAAGAA | (SEQ ID NO: 379) |
| mp5 | 73809 | TGTGCTCCTGACCGACAAGC | (SEQ ID NO: 380) |
| PMT1 | 75421 | GCACAAGCTTGCCCTGACGC | (SEQ ID NO: 381) |
| PMT2 | 22005 | CCAAGAAGAACAGCTCGTAC | (SEQ ID NO: 382) |
| PMT3 | 22527 | AGCCGTGCCCTCGTTCATCC | (SEQ ID NO: 383) |
| ALG3 | 104121 | ACTGCCGTGGACATTGCCAA | (SEQ ID NO: 384) |
| OCH1 | 65646 | CCAAGTTCCCCGCCTACATC | (SEQ ID NO: 385) |
| endoT | 65162 | TGCTCGTTCCACATCAACCA | (SEQ ID NO: 386) |
| pep10 | 78639 | CCTTGTCTATGCGAATGACC | (SEQ ID NO: 424) |
| pep16 | 110490 | AGCAGCAGCAGCACGAGCAG | (SEQ ID NO: 425) |
| pep7 | 58669 | CGCTGCCCATCATCCACGCG | (SEQ ID NO: 426) |
| pep14 | 108686 | TCCACGTTTGAGCTGCGTGT | (SEQ ID NO: 427) |
| pep6 | 68662 | ATCCCCATCCACCAGAAGCG | (SEQ ID NO: 428) |

Example 19

Transcriptome analysis with *Trichoderma reesei* Strains M629 and M507

*Trichoderma reesei* strains M629 (MAB01, pcDNA1-(Kre2)huGnt1, pgpdA-(nat)huGnt2, Δpep1 tsp1 slp1 gap1 gap2 pep4 pep3) and M507 (MAB01, Δpep1 tsp1 slp1 gap1 gap2 pep4 pep3) were cultivated in fermentor with strandard Yeast extract- and Spent grain extract culture medias. Total RNA was purified with standard methods, from samples collected on days 1, 3 and 4 (Yeast exract media) and on days 1, 3 and 5 (Spent grain extract media). mRNA was purified from total RNA samples with Machery-Nagel nucleotrap mRNA kit according to Kits instructions. Conversion to cDNA and preparing for sequencing was made with IlluminaTruSeq Stranded mRNA Sample Prep Kit. 250-450 base pare products were collected for sequencing, with Illumina hiScanSQ sequencer (100+8(index)+100 cycles, paired end run).

For statistical analysis the sequence reads were manipulated as following. The 9134 gene reads originating from the sequencing were cleaned (i.e. genes with all values with zero or average all over conditions below 0.1 were removed) and this resulted 8525 gene reads. Of the 8525 genes potential protease genes were identified based on sequence similarity to other identified *Trichoderma* proteases or the ones of other filamentous fungi (*Aspergillus, Neurospora*). The following proteases either show constant or regulated expression levels in different time points and/or culture conditions (based on FPKM values; fragments per kilobase of exon per million fragments mapped) and should therefore be deleted: a metalloprotease (TR122703), a protease (TR80843), a peptidase (TR72612), a protease (TR47127), a peptidase (TR77577), pep13 (TR76887), a protease (TR56920), a carboxypeptidase (TR120998), a protease (TR65735), a peptidase (TR82141), a metalloprotease (TR121890), a peptidase (TR22718), a peptidase (TR21659), a metalloprotease (TR73809), a protease (TR82452), a peptidase (TR81115), a peptidase (TR64193), a protease (TR23475), a peptidase (TR79485), a metalloprotease (TR4308), a protease (TR122083), a carboxy peptidase (TR61127), a peptidase (TR80762), a peptidase (TR56853), a peptidase (TR22210), a protease (TR111694), a metalloprotease (TR53343), a metalloprotease (TR122576), a protease (TR40199), a protease (TR75159), a protease (TR108592), a protease (TR21668), a protease (TR81070), a protease (TR61912), a protease (TR58387), a protease (TR82577), a protease (TR81087), pep10 (TR78639), pep16 (TR110490), pep7 (TR58669), pep14 (TR108686), pep6 (TR68662) and a protease (TR66608).

Example 20

Cloning and Transformation of *Trichoderma reesei* with Microalgae GnTI, Microalgae α1, 2 Mannosidase Activity, and/or Microalgae α-Glucosidase II Catalytic Domain Coding Sequence This example describes the generation of *T. reesei* strain with the following characteristics:
  it is deficient for alg3 and pep1 protease genes,
  it comprises a recombinant glucosidase II alpha subunit gene, a recombinant alpha 1,2 mannosidase gene and a recombinant GnTI gene originating from a microalgae,
  it comprises GnTII recombinant gene originating from human.

The genes coding for *Phaeodactylum tricornutum* alpha-1,2 mannosidase, GnTI and glucosidase 2 alpha subunit are ordered from a supplier as codon optimized for the expression in *Trichoderma reesei*. Expression vector is then constructed by using these synthetic sequences.

Generation of rituximab producing G0 strain with microalgae GnTI and human GnTII is conducted similarly than strain M290 of *Trichoderma reesei* (Δalg3, Δpep1) described in WO2012/069593. Instead of human chimaeric GnTII/GnTI enzyme used in strain M290, both GnT's are expressed separately from distinct promoters. Human GnTII is expressed with gpdA promoter and microalgae GnTI with cbh1 promoter. Expression cassette is constructed with alg3 flanks for targeting and locus disruption and pyr4-loopout marker is usedutilizing target fragment amplification with e.g. high fidelity polymerase (Phusion; Thermo Scientific) and assembly by Gibson mix (New England Biolabs).

Once the positive clones with G0 glycan structure on rituximab antibody are identified, marker removal (pyr 4) from the best strain is carried out essentially as described in WO 2013/102674. Expression plasmid with glucosidase 2 alpha subunit and alpha-1,2 mannosidase of microalgal origin (*Phaeodactym tricornutum*) is targeted to follow above-mentioned GnT construct already in alg3 locus, as described with *T. reesei* glucosidase 2 alpha subunit overexpression plasmid on example 1. Glucosidase 2 alpha subunit of microalgal origin is expressed under gpdA promoter and alpha 1,2 mannosidase under pCDNA promoter. Both genes are expressed with trpC terminator. Vector contains pyr4 blaster cassette for selection of *T. reesei* transformants.

Once the strain is constructed, pyr4 marker can be removed again as described above and a vector with an expression cassette for microalgal glucosidase II beta subunit may be introduced. The construct can be designed in a manner that this third expression cassette is targeted to the same locus adjacent to the two proteins above, or it can be targeted to a separate locus for simultaneous knockout of a protease or an enzyme from a glycan biosynthesis route.

SEQUENCE LISTING (820 sequences)

SEQ ID NO: 1 - protein, 407 aa, Trichoderma reesei
MQTFGAFLVSFLAASGLAAALPTEGQKTASVEVQYNKNYVPHGPTALFKAKRKYGAPISDNLKSLVAARQAKQALAKRQTGSAPNHPSDSADSEYITSVSIGTPAQVLPLDFDTGSSDLWVFSSETPKSSATGHAIYTPSKSSTSKKVSGASWSISYGDGSSSSGDVYTDKVTIGGFSVNTQGVESATRVSTEFVQDTVISGLVGLAFDSGNQVRPHPQKTWFSNAASSLAEPLFTADLRHGQNGSYNFGYIDTSVAKGPVAYTPVDNSQGFWEFTASGYSVGGGKLNRNSIDGIADTGTTLLLLDDNVVDAYYANVQSAQYDNQQEGVVFDCDEDLPSFSFGVGSSTITIPGDLLNLTPLEEGSSTCFGGLQSSSGIGINIFGDVALKAALVVFDLGNERLGWAQK

SEQ ID NO: 2 - protein, 399 aa, Trichoderma reesei
MQPSFGSFLVTVLSASMAAGSVIPSTNANPGSFEIKRSANKAFTGRNGPLALARTYAKYGVEVPKTLVDAIQLVKSIQLAKRDSATVTATPDHDDIEYLVPVKIGTPPQTLNLDFDTGSSDLWVFSSDVDPTSSQGHDIYTPSKSTSSKKLEGASWNITYGDRSSSSGDVYHDIVSVGNLTVKSQAVESARNVSAQFTQGNNDGLVGLAFSSINTVKPTPQKTWYDNIVGSLDSPVFVADLRHDTPGSYHFGSIPSEASKAFYAPIDNSKGFWQFSTSSNISGQFNAVADTGTTLLLASDDLVKAYYAKVQGARVNVFLGGYVFNCTTQLPDFTFTVGEGNITVPGTLINYSEAGNGQCFGGIQPSGGLPFAIFGDIALKAAYVIFDSGNKQVGWAQKK

SEQ ID NO: 3 - protein, 452 aa, Trichoderma reesei
MEAILQAQAKFRLDRGLQKITAVRNKNYKRHGPKSYVYLLNRFGFEPTKPGPYFQQHRIHQRGLAHPDFKAAVGGRVTRQKVLAKKVKEDGTVDAGGSKTGEVDAEDQQNDSEYLCEVTIGTPGQKLMLDFDTGSSDLWVFSTELSKHLQENHAIFDPKKSSTFKPLKDQTWQISYGDGSSASGTCGSDTVTLGGLSIKNQTIELASKLAPQFAQGTGDGLLGLAWPQINTVQTDGRPTPANTPVANMIQQDDIPSDAQLFTAAFYSERDENAESFYTFGYIDQDLVSASGQEIAWTDVDNSQGFWMFPSTKTTINGKDISQEGNTAIADTGTTLALVSDEVCEALYKAIPGAKYDDNQQGYVFPINTDASSLPELKVSVGNTQFVIQPEDLAFAPADDSNWYGGVQSRGSNPFDILGDVFLKSVYAIFDQGNQRFGAVPKIQAKQNLQPPQ

SEQ ID NO: 4 - protein, 395 aa, Trichoderma reesei
MKSALLAAAALVGSAQAGIHKMKLQKVSLEQQLEGSSIEAHVQQLGQKYMGVRPTSRAEVMFNDKPPKVQGGHPVPVTNFMNAQYFSEITIGTPPQSFKVVLDTGSSNLWVPSQSCNSIACFLHSTYDSSSSSTYKPNGSDFEIHYGSGSLTGFISNDVVTIGDLKIKGQDFAEATSEPGLAFAFGRFDGILGLGYDTISVNGIVPPFYQMVNQKLIDEPVFAFYLGSSDEGSEAVFGGVDDAHYEGKIEYIPLRRKAYWEVDLDSIAFGDEVAELENTGAILDTGTSLNVLPSGLAELLNAEIGAKKGFGGQYTVDCSKRDSLPDITFSLAGSKYSLPASDYIIEMSGNCISSFQGMDFPEPVGPLVILGDAFLRRYYSVYDLGRDAVGLAKAK

SEQ ID NO: 5 - protein, 426 aa, Trichoderma reesei
MKFHAAALTLACLASSASAGVAQPRADEVESAEQGKTFSLEQIPNERYKGNIPAAYISALAKYSPTIPDKIKHAIEINPDLHRKFSKLINAGNMTGTAVASPPPGADAEYVLPVKIGTPPQTLPLNLDTGSSDLWVISTDTYPPQVQGQTRYNVSASTTAQRLIGESWVIRYGDGSSANGIVYKDRVQIGNTFFNQQAVESAVNISNEISDDSFSSGLLGAASSAANTVRPDRQTTYLENIKSQLARPVFTANLKKGKPGNYNFGYINGSEYIGPIQYAAINPSSPLWEVSVSGYRVGSNDTKYVPRVWNAIADTGTTLLLVPNDIVSAYYAQVKGSTFSNDVGMMLVPCAATLPDFAFGLGNYRGVIPGSYINYGRMNKTYCYGGIQSSEDAPFAVLGDIALKAQFVVFDMGNKVVGFANKNTNV

SEQ ID NO: 6 - protein, 446 aa, Trichoderma reesei
MTLPVPLREHDLPFLKEKRKLPADDIPSGTYTLPIIHARRPKLASRAIEVQVENRSDVSYYAQLNIGTPPQTVYAQIDTGSFELWVNPNCSNVQSADQRFCRAIGFYDPSSSSTADVTSQSARLRYGIGSADVTYVHDTISLPGSGSGSKAMKAVQFGVADTSVDEFSGILGLGAGNGINTEYPNFVDELAAQGVTATKAFSLALGSKAEEEGVIIFGGVDTAKFHGELAHLPIVPADDSPDGVARYWVKMKSISLTPPPPSSSGSTDDNNNKPVAFPQTSMTVFLDSGSTLTLLPPALVRQIASALGSTQTDESGFFVVDCALASQDGTIDFEFDGVTIRVPYAEMIRQVSTLPPHCYLGMMGSTQFALLGDTFLRSAYAVFDLTSNVVHLAPYANCGTNVKSITSTSSLSNLVGTCNDPSKPSSSPSPSQTPSASPSSTATQKA

SEQ ID NO: 7 - protein, 488 aa, Trichoderma reesei
MRASPLAVAGVALASAAQAQVVQFDIEKRHAPRLSRRDGTIDGTLSNQRVQGGYFINVQVGSPGQNITLQLDTGSSDVWVPSSTAAICTQVSERNPGCQFGSFNPDDSDTFDEVGQGLFDITYVDGSSSKGDYFQDNFQINGVTVKNLTMGLGLSSSIPNGLIGVGYMNDEASVSTTRSTYPNLPIVLQQQKLINSVAFSLWLNDLDASTGSILFGGIDTEKYHGDLTSIDIISPNGGKTFTEFAVNLYSVQATSPSGTDTLSTSEDTLIAVLDSGTTLTYLPQDMAEEAWNEVGAEYSNELGLAVVPCSVGNTNGFFSFTFAGTDGPTINVTLSELVLDLFSGGPAPRFSSGPNKGQSICEFGIQNGTGSPFLLGDTFLRSAFVVYDLVNNQIAIAPTNFNSTRTNVVAFASSGAPIPSATAAPNQSRTGHSSSTHSGLSAASGFHDGDDENAGSLTSVFSGPGMAVVGMTICYTLLGSAIFGIGWL

SEQ ID NO: 8 - protein, 526 aa, Trichoderma reesei
MRPNSVLLAPLALYASGALAFYPYTPPWLKELEEHNAGEAKRSADNGLTFDIKRRASRRAPASQEEKAAWQAALLSHKYSESVTPSPSPDTTLSKRDNQFSILKAVDPDAPNTAGLAQDGTDYSYFVQASLGSKKTKLYMLLDTGAGSSWVMGTDCVSEACSLHDSFGPEDSDTLKTSTKDFSIAYGSGAVSGSLVNDTIEVAGMSLTYQFGLAHNTSSDFVHFAFDGILGMSMNSGANENFLSALEGAGLLDKSIFSVALARASDGHNDGEVTFGATNPSRYTGDITYTPIPSGTDWSIPLDDMSYNGKKGNVGGINAYIDTGTSYMFGPSKNVKALHAVIDGAKSSDGITWTVPCDTTTPLVVTFSGVDFAISPKDWISPKDSSGKCTSNVYGYEVVSGSWLFGDTFLKNVYAVFDKEQMRIGKTSPRATSPSSPAPTRTPSPATTSPSSASTPGSTPTTSSTRTARPSTSAPSGTSSTGAPSPSASANRDVLRAKRINMLKSISSFWHDPCCCLFLHVSISST

SEQ ID NO: 9 - protein, 761 aa, Trichoderma reesei
MRSTLYGLAALPLAAQALEFIDDTVAQQNGIMRYTLTTTKGATSKHLHRRQDSADLMSQQTGYFYSIQLEIGTPPQAVSVNFDTGSSELWVNPVCSKATDPAFCKTFGQYNHSTTFVDAKAPGGIKYGTGFVDFNYGYDYVQLGSLRINQQVFGVATDSEFASVGILGAGPDLSGWTSPYPFVIDNLVKQGFIKSRAFSLDIRGLDSDRGSVTYGGIDIKKFSGPLAKKPIIPAAQSPDGYTRYWVHMDGMSITKEDGSKFEIFDKPNGQPVLLDSGYTVSTLPGPLMDKILEAFPSARLESTSGDYIVDCDIIDTPGRVNFKFGNVVVDVEYKDFIWQQPDLGICKLGVSQDDNFPVLGDTFLRAAYVVFDWDNQEVHIAANEDCGDELIPIGSGPDAIPASAIGKCSPSVKTDTTTSVAETTATSAAASTSELAATTSEAATTSSEAATTSAAAETTSVPLNTAPATTGLLPTTSHRFSNGTAPYPIPSLSSVAAAAGSSTVPSESSTGAAAAGTTSAATGSGSGSGSGDATTASATYTSTFTTTNVYTVTSCPPSVTNCPVGHVTTEVVVAYTTWCPVENGPHPTAPPKPAAPEITATFTLPNTYTCSQGKNTCSNPKTAPNVIVVTPIVTQTAPVVIPGIAAPTPTPSVAASSPASPSVVPSPTAPVATSPAQSAYYPPPPPPEHAVSTPVANPPAVTPAPAPFPSGGLTTVIAPGSTGVPSQPAQSGLPPVPAGAAGFRAPAAVALLAGAVAAALL

SEQ ID NO: 10 - protein, 477 aa, Trichoderma reesei
MRFVQYVSLAGLFAAATVSAGVVTVPFEKRNLNPDFAPSLLRRDGSVSLDAINNLTGGGYYAQFSVGTPPQKLSFLLDTGSSDTWVNSVTADLCTDEFTQQTVGEYCFRQFNPRRSSSYKASTEVFDITYLDGRRIRGNYFTDTVTINQANITGQKIGLALQSVRGTGILGLGFRENEAADTKYPTVIDNLVSQKVIPVPAFSLYLNDLQTSQGILLFGGVDTDKFHGGLATLPLQSLPPSIAETQDIVMYSVNLDGFSASDVDTPDVSAKAVLDSGSTITLLPDAVVQELFDEYDVLNIQGLPVPFIDCAKANIKDATFNFKFDGKTIKVPIDEMVLNNLAAASDEIMSDPSLSKFFKGWSGVCTFGMGSTKTFGIQSDEFVLLGDTFLRSAYVVYDLQNKQIGIAQATLNSTSSTIVEFKAGSKTIPGPASTGDDSDDSSDDSDEDSAGAALHPTFSIALAGTLFTAVSMMMSVL

SEQ ID NO: 11 - protein, 259 aa, Trichoderma reesei
MAPASQVVSALMLPALALGAAIQPRGADIVGGTAASLGEFPYIVSLQNPNQGGHFCGGVLVNANTVVTAAHCSVVYPASQIRVRAGTLTWNSGGTLVGVSQIIVNPSYNDRTTDFDVAVWHLSSPIRESSTIGYATLPAQGSDPVAGSTVTTAGWGTTSENSNSIPSRLNKVSVPVVARSTCQADYRSQGLSVTNNMFCAGLTQGGKDSCSGDSGGPIVDANGVLQGVVSWGIGCAEAGFPGVYTRIGNFVNYINQNLA

SEQ ID NO: 12 - protein, 882 aa, Trichoderma reesei
MVRSALFVSLLATFSGVIARVSGHGSKIVPGAYIFEFEDSQDTADFYKKLNGEGSTRLKFDYKLFKGVSVQLKDLDNHEAKAQQMAQLPAVKNVWPVTLIDAPNPKVEWVAGSTAPTLESRAIKKPPIPNDSSDFPTHQMTQIDKLRAKGYTGKGVRVAVIDTGIDYTHPALGGCFGRGCLVSFGTDLVGDDYTGFNTPVPDDDPVDCAGHGSHVAGIIAAQENPYGFTGGAPDVTLGAYRVFGCDGQAGNDVLISAYNQAFEDGAQIITASIGGPSGWAEEPWAVAVTRIVEAGVPCTVSAGNEGDSGLFFASTAANGKKVIAVASVDNENIPSVLSVASYKIDSGAAQDFGYVSSSKAWDGVSKPLYAVSFDTTIPDDGCSPLPDSTPDLSDYIVLVRRGTCTFVQKAQNVAAKGAKYLLYYNNIPGALAVDVSAVPEIEAVGMVDDKTGATWIAALKDGKTVTLTLTDPIESEKQIQFSDNPTTGGALSGYTTWGPTWELDVKPQISSPGGNILSTYPVALGGYATLSGTSMACPLTAAAVALIGQARGTFDPALIDNLLATTANPQLFNDGEKFYDFLAPVPQQGGGLIQAYDAAFATTLLSPSSLSFNDTDHFIKKKQITLKNTSKQRVTYKLNHVPTNTFYTLAPGNGYPAPFPNDAVAAHANLKFNLQQVTLPAGRSITVDVFPTPPRDVDAKRLALWSGYITVNGTDGTSLSVPYQGLTGSLHKQKVLYPEDSWIADSTDESLAPVENGTVFTIPAPGNAGPDDKLPSLVVSPALGSRYVRVDLVLLSAPPHGTKLKTVKFLDTTSIGQPAGSPLLWISRGANPIAWTGELSDNKFAPPGTYKAVFHALRIFGNEKKKEDWDVSESPAFTIKYA

SEQ ID NO: 13 - protein, 541 aa, Trichoderma reesei
MRSVVALSMAAVAQASTFQIGTIHEKSAPVLSNVEANAIPDAYIIKFKDHVGEDDASKHHDWIQSIHTNVEQERLELRKRSNVFGADDVFDGLKHTFKIGDGFKGYAGHFHESVIEQVRNHPDVEYIERDSIVHTMLPLESKDSIIVEDSCNGETEKQAPWGLARISHRETLNFGSFNKYLYTADGGEGVDAYVIDTGTNIEHVDFEGRAKWGKTIPAGDEDEDGNGHGTHCSGTVAGKKYGVAKKAHVYAVKVLRSNGSGTMSDVVKGVEYAALSHIEQVKKAKKGKRKGFKGSVANMSLGGGKTQALDAAVNAAVRAGVHFAVAAGNDNADACNYSPAAATEPLTVGASALDDSRAYFSNYGKCTDIFAPGLSIQSTWIGSKYAVNTISGTSMASPHICGLLAYYLSLQPAGDSEFAVAPITPKKLKESVISVATKNALSDLPDSDTPNLLAWNGGGCSNFSQIVEAGSYTVKPKQNKQAKLPSTIEELEEAIEGDFEVVSGEIVKGAKSFGSKAEKFAKKIHDLVEEEIEEFISELSE

SEQ ID NO: 14 - protein, 391 aa, Trichoderma reesei
MRLSVLLSVLPLVLAAPAIEKRAEPAPLLVPTTKHGLVADKYIVKFKDGSSLQAVDEAISGLVSNADHVYQHVFRGFAATLDKETLEALRNHPEVDYIEQDAVVKINAYVSQTGAPWGLGRISHKARGSTTYVYDDSAGAGTCSYVIDTGVDATHPDFEGRATLLRSFVSGQNTDGNGHGTHVSGTIGSRTYGVAKKTQIYGVKVLDNSGSGSFSTVIAGMDYVASDSQTRNCPNGSVANMSLGGGYTASVNQAAARLIQAGVFLAVAAGNDGVDARNTSPASEPTVCTVGASTSSDARASFSNYGSVVDIFAPGQDILSTWPNRQTNTISGTSMATPHIVGLGAYLAGLEGFSDPQALCARIQSLANRNLLSGIPSGTINAIAFNGNPSG

SEQ ID NO: 15 - protein, 387 aa, Trichoderma reesei
MGLVTNPFAKNIIPNRYIVVYNNSFGEEAISAKQAQFAAKIAKRNLGKRGLFGNELSTAIHSFSMHTWRAMALDADDIMIKDIFDAEEVAYIEADTKVQHAALVAQTNAAPGLIRLSNKAVGGQNYIFDNSAGSNITAYVVDTGIRITHSEFEGRATFGANFVNDDTDENGHGSHVAGTIGGATFGVAKNVELVAVKVLDADGSGSNSGVLNGMQFVVNDVQAKKRSGKAVMNMSLGGSFSTAVNNAITALTNAGIVPVVAAGNENQDTANTSPGSAPQAITVGAIDATTDIRAGFSNFGTGVDIYAPGVDVLSVGIKSDIDTAVLSGTSMASPHVAGLAAYLMALEGVSNVDDVSNLIKNLAAKTGAAVKQNIAGTTSLIANNGNF

SEQ ID NO: 16 - protein, 409 aa, Trichoderma reesei
MASLRRLALYLGALLPAVLAAPAVNYKLPEAVPNKFIVTLKDGASVDTDSHLTWVKDLHRRSLGKRSTAGVEKTYNIDSWNAYAGEFDEETVKQIKANPDVASVEPDYIMWLSDIVEDKRALTTQTGAPWGLGTVSHRTPGSTSYIYDTSAGSGTFAYVVDSGINIAHQQFGGRASLGYNAAGGDHVDTLGHGTHVSGTIGGSTYGVAKQASLISVKVFQGNSASTSVILDGYNWAVNDIVSRNRASKSAINMSLGGPASSTWATAINAAFNKGVLTIVAAGNGDALGNPQPVSSTSPANVPNAITVAALDINWRTASFTNYGAGVDVFAPGVNILSSWIGSNTATNTISGTSMATPHVVGLALYLQALEGLSTPTAVTNRIKALATTGRVTGSLNGSPNTLIFNGNSA

SEQ ID NO: 17 - protein, 555 aa, Trichoderma reesei
MRACLLFLGITALATAIPALKPPHGSPDRAHTTQLAKVSIALQPECRELLEQALHHLSDPSSPRYGRYLGREEAKALLRPRREATAAVKRWLARAGVPAHDVLTDGQFIHVRTLAEKAQALLGFEYNSTLGSQTIAISTLPGKIRKHVMTVQYVPLWTEADWEECKTIITPSCLKRLYHVDSYRAKYESSSLFGIVGFSGQAAQHDELDKFLHDFAPYSTNANFSIESVNGGQSPQGMNEPASEANGDVQYAVAMGYHVPVRYYAVGGENHDIIPDLDLVDTTEEYLEPFLEFASHLLDLDDDELPRVVSISYGANEQLFPRSYAHQVCDMFGQLGARGVSIVVAAGDLGPGVSCQSNDGSARPKFIPSFPATCPYVTSVGSTRGIMPEVAASFSSGGFSDYFARPAWQDRAVGAYLGAHGEEWEGFYNPAGRGFPDVAAQGVNFRFRAHGNESLSSGTSLSSPVFAALIALLNDHRSKSGMPPMGFLNPWIYTVGSHAFTDIIEARSEGCPGQSVEYLASPYIPNAGWSAVPGWDPVTGWGTPLFDRMLNLSLV

SEQ ID NO: 18 - protein, 388 aa, Trichoderma reesei
MAWLKKLALVLLAIVPYATASPALSPRSREILSLEDLESEDKYVIGLKQGLSPTDLKKHLLRVSAVQYRNKNSTFEGGTGVKRTYAIGDYRAYTAVLDRDTVREIWNDTLEKPPWGLATLSNKKPHGFLYRYDKSAGEGTFAYVLDTGINSKHVDFEGRAYMGFSPPKTEPTDINGHGTHVAGIIGGKTFGVAKKTQLIGVKVFLDDEATTSTLMEGLEWAVNDITTKGRQGRSVINMSLGGPYSQALNDAIDHIADMGILPVAAAGNKGIPATFISPASADKAMTVGAINSDWQETNFSNFGPQVNILAPGEDVLSAYVSTNTATRVLSGTSMAAPHVAGLALYLMALEEFDSTQKLTDRILQLGMKNKVVNLMTDSPNLIIHNNVK

SEQ ID NO: 19 - protein, 256 aa, Trichoderma reesei
MFIAGVALSALLCADTVLAGVAQDRGLAARLARRAGRRSAPFRNDTSHATVQSNWGGAILEGSGFTAASATVNVPRGGGGSNAAGSAWVGIDGASCQTAILQTGFDWYGDGTYDAWYEWYPEFAADFSGIDIRQGDQIAMSVVATSLTGGSATLENLSTGQKVTQNFNRVTAGSLCETSAEFIIEDFEECNSNGSNCQPVPFASFSPAITFSSATATRSGRSVSLSGAEITEVIVNNQDLTRCSVSGSSTLTCSYV

SEQ ID NO: 20 - protein, 236 aa, Trichoderma reesei
MDAIRARSAARRSNRFQAGSSKNVNGTADVESTNWAGAAITTSGVTEVSGTFTVPRPSVPAGGSSREEYCGAAWVGIDGYSDADLIQTGVLWCVEDGEYLYEAWYEYLPAALVEYSGISVTAGSVVTVTATKTGTNSGVTTLTSGGKTVSHTFSRQNSPLPGTSAEWIVEDFTSGSSLVPFADFGSVTFTGATAVVNGATVTAGGDSPVIIDLEDSRGDILTSTTVSGSTVTVEYE

SEQ ID NO: 21 - protein, 513 aa, Trichoderma reesei
MAVLSRLALTASFALCGVSAAGIQQPLTAPESLPPSHEAVADYGSKPIIDSEALQSAISIDTLVKRAESFYKFAKASEEEYGHPTRVIGSAGHEQTLNYITNTLLDHGDYYNVSVQEFPVTLSNVFQFRLVLADEVSKSAIPMGLTPPTKDKEPVHGDLVLVQNSGCDASDYPQNVKGNIAFIRRGACSFGDKSIGAGKAGAKAAVIYNTDPEELHGTLGLPVEDHIATFGIDGVEGKKILAKLSNGESVDAIAYIDAEVKQIQTVNVLAQTEEGDPDNCVMLGGHSDGVAEGPGINDDGSGSISVLEVAVQLTKFKVNNCVRFAWWAAEEEGLLGSDFYAASLSDEENQKIRLFMDYDMMASPNFAYQIYNATNAESPAGSEELRNLYVDWYKSQGLNYTFIPFDGRSDYDGFIRAGIPAGGIATGAEAVKTKEEAEMFGGRAGEWLDPCYHQLCDDLGNLNHTAWEVNTKLIAHSVATYALSFDGFPKRKLETEMSAYSQTTKHHGPKLIL

SEQ ID NO: 22 - protein, 515 aa, Trichoderma virens
MAVLSKLALAASFALCGVSAAGIQQQPLTAPSSLSSSHETAVDYSSKPLIDSEALQNAISIDALVKRAEKFYKFAQTSEEEYGHPTRVIGSSGHEETLNYIANTLLDLGDYYNVSVQEFPVTLSNVFQFRLVLADEVSKSAIPMGLTPPTKDKEPVHGDLVLVKNSGCNASDYPKNVKGNIAFIRRGECAFGDKSIGAGKAGAKAAVIFNTDPEELHGTLGLPVEDHIATFGIDGVEGKKIADKLADGESLDAIAYIDAEVKQIQTVNVLAQTEQGDPDNCVMLGGHSDGVAEGPGINDDGSGSMSVLEVAVQLTKFKVNNCVRFAWWAAEEEGLLGSDFYAENLSEEENQKIRLFMDYDMMASPNFAYQIYNATNAESPAGSEELRNLYVDWYKSQGLNYTFIPFDGRSDYDGFIRAGIPAGGIATGAEAVKTKEEEEMFGGHAGQWLDPCYHQLCDDLGNLNHTAWEVNTKLIAHSVATFALSFEGFPKREVESETISAYGQTMKHHGPKLIL

SEQ ID NO: 23 - protein, 511 aa, Trichoderma atroviride
MAVLSRLALTASFALSASAAGLGGSWQQSPLTSPSSLSSSQGSKPLISTEALQEAISIDALVERAQKFYKFAQTSEEDYGHPTRVIGSTGHERTLNYIVNTLLDQGDYYTISTQEFPVTLSNVFESQLVLGSSVSKSAVPMGLTPATRDREPVHGQLVLVNNDGCHDSDYPKNVKGNIAFIRRGACAFGDKSIGAGKAGAKAAVIYNTDPEELHGTLGEPTKYHVATFGIDGTEGNAVAEKLAKGESVSAIAYIDAEVKQIQTVNVLAQTDEGDPDNCVMLGGHSDGVAEGPGINDDGSGSMSVLEVAVQLAKFKVNNCVRFAWWAAEEEGLLGSDFYAASLSEEENQKIRLFMDYDMMASPNFAYQIYNATNAYNPAGSEELRDLYVDWYKSQGLNYTFIPFDGRSDYDGFIRAGIPAGGIATGAEAVKTKEEEEMFGGHAGQWLDPCYHQICDDLGNLNHTAWEVNTKLIAHSVATYALSFDGFPKREQETKISSYSETIKQHGPKLIM

SEQ ID NO: 24 - protein, 510 aa, Fusarium graminicola
MTTKSFCLVAATAALSGVSALQIPLNLQVPKLSWSPFSDDLPLVDTKELQKSIKPENLEARAKDLYEIAKNGEEEYGHPTRVIGSEGHLGTLSYIHAELAKLGGYYTVSNQQFPAVSGNVFESRLVLGNDVPKEAAPMGLTPPTKNKEPVYGKLVLVDNEGCNESDYPEAVKGNIALVLRGTCPFGTKSGNAGKAGAVAAVVYNYEKGDVHGTLGTPSPDHIATFGLGGDEGKAVVKKIKDGEEVDAIAYIDAEVKTISTTNIIAQTRGGDPDNCVMLGGHSDSVAEGPGINDDGSGSISVLEVAVQLTKYRVNNCVRFAWWAAEEEGLLGSDHYVSVLSDEENQKIRLFMDYDMMASPNFAYQIYNATNAANPKGSEELRNLYVDWYEEQGLNYTFIPFDGRSDYDGFIRGGIPAGGIATGAEGVKTEEEVAMFGGEAGVWYDKNYHQIGDDLTNVNYTAWEVNTKLIAHSVATYAKSFKGFPERSSEAVVQSETYSDKTKYHGSKLFL

SEQ ID NO: 25 - protein, 502 aa, Aspergillus nidulans
MRPAAVSLGLIGGISALGIPLPETLEQLPLSDAQKPLVSSEGLQAQIHVSNLLDRAKVLYSLAERGIDEYNHPTRVIGSKGHWGTLDYIYSTIMELGDYYDVTNQSFPAVSGNVFESRLVLGHEVPASARPMGLTPPTKNREPVYGSLILVSNEGCDKADYPSELAGAIALIQRGTCPFGTKSELAGKAGAVAAVVYNNEHGEVSGTLGTPSPYHVATFGISDTDAAPYVQQLKEGKKVDSIAYIDATVDTIYTTNIIAQTRRGDPENCVMLGGHSDSVAEGPGINDDGSGTLTLLEVATQLSKYDVNNCVRFAWWAAEEEGLLGSDYYVSVLSEEENLKIRLFMDYDMLASPNFAYQVYNATNEVNPVGSEELRDLYTEFYTSHGLNFTYIPFDGRSDYDGFIRNGIPGGGIATGAEGVKTDEEQEMFGGIAGNWYDPCYHQLCDDLGNVNATAWEVNSKLVAHTVATYAVSFEGFPKRTTTNVKSVDLEKRKYHGPKLLM

SEQ ID NO: 26 - protein, 508 aa, Aspergillus niger
MRIDSAALHLVPVLLGQVGALQLPLVQDSNSQWQKPNAGDKPLISSPLLQEQVKAENLLDRARQLYKIAELGEDEYNHPTRVIGSKGHLGTLDYIYSTLTDLGDYYTVVNQSFPAVSGNVFESRLVLGHDVPKSATPMGLTPPTRNKEPVYGSLVAVSNLGCEASDYPSNLKGAVAFISRGSCPFGTKSQLAGKAGAVAAVIYNNERGDLSGTLGNPTPDHVATFGISDEDAAPVLEKLNKGEKVDAIAYVDAIVETIHTTNIIAQTTDGDPNNCVMLGGHSDSVAEGPGINDDGSGTLTLLELATLLTQFRVNNCVRFAWWAAEEEGLLGSDYYVSVLTPEENRKIRLFMDYDMLGSPNFAYQVYNATNAVNPEGSEELRDLYTDFYEDHGFNYTYIPFDGRSDYDAFIRHGIPGGGIATGAEGIKTVEEADMFGGVAGQWYDPCYHQICDTVANVNLTAWEWNTKLVAHSIATYAKSFDGFPERSDEPISPAAFEEPKYHGHALQL

SEQ ID NO: 27 - protein, 503 aa, Aspergillus oryzae
MRLQLPEVAIATLLLGEVGAVQLPLLQSQVPITSDKELVSSSAFQSHVKAENLLKRAKELSKIADLGEEEYNHPTRVIGSKGHLGTIDYIYSTLAKLGDYYTITNQSFPAVTGNVFESRLVLGDAVPESAAPMGLTPPTKNKQPVHAPLVAVSNFGCDASDFPSDVSGAIALISRGTCPFGTKSELAGKAGAVAAVVYNNEKGSLSGTLGNPTPDHVATWGLSDEDAAPILEKLEKGEEVDGIAYMDAIVETIHTTNIIAQTTEGDPENCVMLGGHSDSVAEGPGINDDGSGSLTLLELATLLTQYRVNNCVRFAWWAGEEEGLLGSDYYVSVLTPEENLKIRLFMDYDMLGSPNFAYQVYNATNSVNPVGSEELRDLYVDFYNDHDLNYTYIPFDGRSDYDAFIRHGIPGGGIATGAEGIKTPEEQEMFGGVAGAWYDPCYHQICDVVGNVNLTAWELNTKLVAHSVATYARSFEGFPKRTKDSITAFATENNKYHGPRLVL

SEQ ID NO: 28 - protein, 524 aa, Aspergillus fumigatus
MVASTIHLLCTAFALTAEGAALQLPLFGASEPQIPVAGKELISSSALQSQIDVGKLLNRAKHLYSIAELGSDEYNHPTRVIGSKGHLGTLDYIYATLTEFDDYYTISNQTFPAVTGNVMESRLVLGHTVPESALPMGLTPPTKNHEPVYGPLVLVSRLGCEAADYPPELQGAIAFISRGSCPFGTKSALAGKAGAVAAVIFNNEKGGLGGTLGTPSPDHVATFGLSDSDAAPFLEQLRRGQKVDAIAYMDATVETITTTNIIAQTKEGDADNCVMAGAHSDSVMEGPGINDDGSGSLTLLEIASLLPHYRVNNCVRLAWWAGEEEGLLGSDYYVSVLSEAENLKIRLFMDYDMLASPNFAYQVYNATNAVNPVGSEQLRDLYTEFYEAHGLNFTYIPFDGRSDYDAFIRNGIPGGGIATGAEVIKTEEEQKMFGGVAGDAFDPCYHQLCDDVSNVNLTAWEVNTKVRVDFCVYTRRRLLICTQLVAHSIATYARSFDGFPKRIKVESMKKGDEQRKYHGHSLLY

SEQ ID NO: 29 - protein, 511 aa, Myceliophtora thermophila
MRTPAASLLAFALPALATAGGHGGSSGLGCDSQRPLVSSEKLQSLIKKEDLLAGSQELQDIATAHGGHRAFGSSGHNATVDFLYYTLKALDYYNVTKQPFKEIFSSGTGSLTVDGEDIEAETLTYTPSGSATDKPVVVVANVGCDAADYPAEVAGNIALIKRGTCTFSQKSVNAKAAGAVAAIIYNNAEGKLSGTLGQPFLDYAPVLGITLEAGEALLAKLAGGPVTATLQIDALVEERVTYNVIAETKEGDHSNVLVLGGHTDSVPAGPGINDDGSGTIGMLTVAKALTKFRVKNAVRFAFWSAEEYGLLGSYAYIKSINSSAAELSKIRAYLNFDMIASPNYIYGIYDGDGNAFNLTGPAGSDVIERNFENFFKRKHTPSVPTEFSGRSDYAAFIENGIPSGGLFTGAEVLKTEREAELFGGRAGVAYDVNYHQAGDTVDNLALDAFLLNTKAIADSVATYALSFDGLPRVDGKKRRWDAHRARMLKRSAGSHGHAHLHSGPCGGGASI

SEQ ID NO: 30 - protein, 492 aa, Fusarium graminicola
MKYSTILALAGLASASTPKKPLVNELKLQKDITLKGLMAGAQKLQDIAEANDDTRVFGGKGHNATVDYLYNTLKSLNYYNVKKQPFTELYSAGTASLKADGEDIAAAIMTYTPAGEASGPLVVAANLGCEASDFPAESKGKVVLVKRGECAFSAKSTNGKTAGASAVIVYNNVAGELSGTLGEPFGNFAPIVGISLESGEAILAKTKAGEVKVDLKVDATVENRVTFNVIAETKEGDHDNVLVVGGHSDSVAAGPGINDDGSGIIGILNVAKALTKYRVKNAVRFGFWSAEEFGLLGSYAYMKSINSSDTEIAKIRAYLNFDMIASPNYVYGIYDGDGDAFNLTGPAGSDAIEKDFEKFFKTKRLASVPSEFSGRSDYAAFIENGIPSGGLFTGAEQLKTEEEAKKFGGEAGVAYDINYHKAGDTIDNLNKEAFLVNTQAIANSVAKYAKSFKGIPQVNHLTRRRDADHAQIFKRTSAHTHAHGGPCGAVEV

SEQ ID NO: 31 - protein, 493 aa, Penicilium Chrysogenum
MKWSLLITHLSVAFAEAGRRKPLVSPDEFPSAIRLKDLLKGTQQLEDFAYAYPERNRVFGSAAHNDTVDYIYRELKKTGYYHVWKQPQVHTWTTAKTSLTFDGESIEATAMTYSPSADVTAEMAVVSNLGCSASDYPSGVAGGIALVQRGECSFGEKSVLAAAAKASAVIIYNNEAGPVSGTLGGVTNELGPYAAIAGISDVDGKTLLDAAAKGAVTLSVSIDSRVENRTTFNVIAETKGGDHNNVVSLGGHTDSVDAGPGINDDGSGVISNLVVAKALTRFSVKNAVRFFFWTAEEFGLLGSEYYTSHLDADELAKIRLYLNFDMIASPNYALMIYDGDGDAFNQTGPAGSAEIEALFEDYYKSKKLPYIPTAFDGRSDYDGFISRGIPAGGIFTGAEGAKTEEEAKLFGGEAGVAYDVNYHAAGDDFKNLNHEAFLINSKATAFAVAKYANSLASIPRHSATPTKRVVKKRAPRSHAHTKNTGCFHSLVEI

SEQ ID NO: 32 - protein, 501 aa, Aspergillus fumigatus
MVTMKLLYLTSFASLAVANGPGWDWKPRVHPKVLPQMIHLWDLLQGAQQLEDFAYAYPERNRVFGGRAHEDTVNYLYRELKKTGYYDVYKQPQVHQWTRADQALTVDGQSYDATTMTYSPSVNATAPLAVVNNLGCVEADYPADLTGKIALISRGECTFATKSVLSAKAGAAAALVYNNIEGSMAGTLGGATSELGAYAPIAGISLADGQALIQMIQAGTVTANLWIDSQVENRTTYNVIAQTKGGDPNNVVALGGHTDSVEAGPGINDDGSGIISNLVVAKALTRFSVKNAVRFCFWTAEEFGLLGSNYYVNSLNATEQAKIRLYLNFDMIASPNYALMIYDGDGSAFNLTGPAGSAQIERLFEDYYTSIRKPFVPTEFNGRSDYQAFILNGIPAGGLFTGAEAIKTEEQAQLFGGQAGVALDANYHAKGDNMTNLNREAFLINSRATAFAVATYANSLDSIPPRNMTTVVKRSQLEQAMKRTPHTHTGGTGCYKDRVEQ

SEQ ID NO: 33 - protein, 496 aa, Aspergillus oryzae
MRSLLWASLLSGVLAGRALVSPDEFPEDIQLEDLLEGSQQLEDFAYAYPERNRVFGGKAHDDTVNYLYEELKKTGYYDVYKQPQVHLWSNADQTLKVGDEEIEAKTMTYSPSVEVTADVAVVKNLGCSEADYPSDVEGKVALIKRGECPFGDKSVLAAKAKAAASIVYNNVAGSMAGTLGAAQSDKGPYSAIVGISLEDGQKLIKLAEAGSVSVDLWVDSKQENRTTYNVVAQTKGGDPNNVVALGGHTDSVEAGPGINDDGSGIISNLVIAKALTQYSVKNAVRFLFWTAEEFGLLGSNYYVSHLNATELNKIRLYLNFDMIASPNYALMIYDGDGSAFNQSGPAGSAQIEKLFEDYYDSIDLPHIPTQFDGRSDYEAFILNGIPSGGLFTGAEGIMSEENASRWGGQAGVAYDANYHAAGDNMTNLNHEAFLINSKATAFAVATYANDLSSIPKRNTTSSLHRRARTMRPFGKRAPKTHAHVSGSGCWHSQVEA

SEQ ID NO: 34 - protein, 503 aa, Aspergillus nidulans
MKSILVPALSLASLAWAGKHKPLVTPEALQDLITLDDLLAGSQQLQDFAYAYPERNRVFGGRAHDDTVNWLYRELKRTGYYHVYKQPQVHLYSNAEESLTVNGEAIEATTMTYSPSANASAELAVISGLGCSPADFASDVAGKVVLVQRGNCTFGEKSVYAAAADAAATIVYNNVEGSLSGTLGAAQSEQGPYSGIVGISLADGEALLALAEEGPVHVDLWIDSVMENRTTYNVIAQTKGGDPDNVVTLGGHSDSVEAGPGINDDGSGIISNLVIARALTKFSTKHAVRFFFWTAEEFGLLGSDYYVSSLSPAELAKIRLYLNFDMIASPNYGLLLYDGDGSAFNLTGPAGSDAIEKLFYDYFQSIGQATVETEFDGRSDYEAFILNGIPAGGVFTGAEEIKSEEEVALWGGEAGVAYDANYHQVGDTIDNLNTEAYLLNSKATAFAVATYANDLSTIPKREMTTAVKRANVNGHMHRRTMPKKRQTAHRHAAKGCFHSRVEQ

SEQ ID NO: 35 - protein, 508 aa, Neurospora crassa
MRTAAASLATLALAVPALAATIQGGPTRKPYVCSDALQYQITEKDIRAGAQKLQDIANANNGTRVFGSTGHNATVDFLYNTLKDTGYYDVYKQPFVETYSAGTGSLSVNGKALDVRIMTYTPAGSATGPIVYAEGLGCSAAEYPAEASGNIVLVSRGNCTFGQKALSAKEAGAVGLVIYNNVDGSLSGTLGEAFKDYAPVVGLSKEDGEALIASIKGGEEIKAEFKVDAVTEHRVSFNVIAETKGGDHNNVLIVGGHSDSVAAGPGINDDGSGVIGILTVAKALAKFQVKNAVRFGFWSAEEFGLLGSEYYVKSLNGSKTELAKIRAYLNFDMIASPNYIYGIYDGDGSAFNLTGPQGSDVIEKDFEQFFSKNKVASVPSEFNGRSDYAAFIENGIPSGGIFTGAEGIKTEAEAAAVGGTAGIAYDVNYHQAGDTIDNIAWDAFLLNTRAIANSVAKYARSFKSLPAINLMQRRWDGDVAQTLKRNKKRANGAHVHSHSGPCGGGEEI

SEQ ID NO: 36 - protein, 493 aa, Myceliophtora thermophila
MRLLRTAGAATLFLSPATFATNNPLTPGKLEADIRTEELQNVLWNLNHIAVTHGGNRAFGEPGYKASLDFILERAQTRFHNEFDTVVQPFNHTYGKTNQIKVTGPEGEDVFVISPLYNPATPLPDGITAPLVDTPVDDERGSACFPDQWEGVDVKGKLVLVKRGICAVADKSALAKERGALGVILYNEQPGTNIVVPTLGAESIGKTVPIGIIPLEVGQSWKSRLADGEEVTVHLLVDSISDTRETWNIIAETKQGDPDKVIMLGAHLDSVQAGAGINDDGSGTAALLEILTAVRRYDGFPHKIRFAWWAAEESGLVGSLYYTSHLTEEEADRIKYYFNYDMIGSPHPDFEIASDGNSGVGPQLLEEYLVEQGKEIVHGGFGSGSDFVGFLELGIPSTALHTGAGAPFDECYHQACDDLDNINWEALTVNAKAAARAAARLANSLEGVPPRKKTSLNLHTRRGVVQNFRKWASLAEEASHGHTCSHTGKRVVV

SEQ ID NO: 37 - protein, 605 aa, Trichoderma reesei
MAATRDPTTLSNYGAWRTKHTSASFNIDFDNKRLVGSVVLQLESQTDKQSTEIVLDSRFVKVSSVAVDGAAAQWELKPHSDPFGAPLHIQVPHGAAKGDVVRVAIELETTSKCTALQWLTPAQTSNKKHPYMFSQCQAINARSIFPCQDTPDVKSTISFKFTSTLPVVASGVAVGDHTATPGVEKVYEFEQKVPIPSYLFAVASGDIVAAPIGSRSKVVTGPNELKGCQWELERDMEKFLEIAESIVFPYRWGEYNVLVLPPSFPYGGMENPIYTFATPTIISGDRQNVDVIAHELAHSWSGNLVSNASWEHFWLNEGWTVYLERRIEAAVHGEPQFDFSSIIGWKALEDAVAHFGKDHEYTKLIISHDNVDPEDVYSTVAYEKGFHFLYYLDRLVGRDNFNKFIPHYFTKWAGKSLDSFEFRDTFVDFFNNLGDEEVKQKVATIDWEGRFYTPGLPPKPEFDTTLASQCYELAEKWKDASYEPSPKDVEGFSSNQKIVFLEKLQQFEPLSTDRAQLLGKVYDLLNTQNVELKFAYLQLALKANDASSYQTTADLLGKVGRMKFVRPLFRSLNKVDRNLALETFAKNKDFYHPICRGMVEKDLGV

SEQ ID NO: 38 - protein, 636 aa, Trichoderma virens
MSWFSLRVGLLRSTNRIITSYARRGFATINTMAGTRDPTTLSNYGAWRTRHTTANFNIDFENKRLKGSVVLQLESQTDKESKEIILDSRFVNVSSVNVNDTASKWELKPHSDPFGAPLHVQVPDGAAKGEIVHLAIELETTSKCTALQWLTPAQTSNKKHPYMFSQCQAINARSIFPCQDTPDVKSTISFKFTSTLPVVASGVAVGDHTATPGVEKVYEFEQKVPIPSYLFAVASGDIVAAPIGSRSKVVTGPNELKGCQWELERDMEKFLEIAESIVFPYKWGEYNVLVLPPSFPYGGMENPIYTFATPTIISGDRQNVDVIAHELAHSWSGNLVSNASWEHFWLNEGWTVYLERRIEAAVHGEPQFDFSSIIGWKALEDAVAHFGADHEYTKLIISHDNVDPEDVYSTVAYEKGFHFLYYLDRLVGRDNFNKFIPHYFTKWAGKSLDSFEFRDTFVDFFNNLGDEEVKQKVATIDWEGRFYTPGLPPKPEFDTTLAGQCYELAEKWKDASYVPNAKDIESFSSNQKIVFLEKLQQYEPLSSERAQLLGSAYDLLNTQNVELKFAYLQIALKANDSTSYQTTADLLGKVGRMKFVRPLFRSLSKVDRSLALETFAKNKDFYHPICRGMVEKDLGV

SEQ ID NO: 39 - protein, 604 aa, Trichoderma atroviride
MAKRDPTTLSNYDAWRTKHTTASFSIDFDNKRLKGSVVLQLESQTDKQSNEIILDSRFVKVSSVNVNSAESKWELKPHSDPFGAPLHVQVPDGAAKGDIVNLAIELETTSKCTALQWLTPAQTSNKKHPYMFSQCQAINARSIFPCQDTPDVKSTISFKFTSTLPVVASGVAVGDHTATPGVEKVYEFEQKVPIPSYLFAVASGDIVSAPIGSRSKVVTGPNELEGCKWELERDMEKFLEIAESIVFPYKWGEYNVLVLPPSFPYGGMENPIYTFATPTIISGDRQNVDVIAHELAHSWSGNLVSNASWEHFWLNEGWTVYLERRIEAAVHGEPQFDFSSIIGWKALEDAVAHFGKDHEYTKLIISHDNVDPEDVYSTVAYEKGFHFLYYLDRLVGRENFNKFIPHYFTKWAGKSLDSFEFRDTFVDFFNGLGDEDIKKKVATIDWEGKLYTPGLPPKPEFDMTLAGQCYELAAKWENDSYEPSAKDVESFSSNQKIVFLEKLQQHGALSTERAQLLGKVYSLLDTQNVELQFAYLQIALKANDSTSYQSTADLLGKVGRMKFVRPLFRSLNKVDRSLALETFAKYKDFYHPICRGMVEKDLGV

SEQ ID NO: 40 - protein, 639 aa, Fusarium graminicola
MSWFSSLKKPSILRTCQVTITHNLRRTFATVNPNMTANRDPSTLSNYSAWRTRHTTANFKIDFDQKALKGSVVLQLESQTDKESKEIILDTRYVDISSISIDSKESKWELKSFNAPLGAPLHIAVPDGVAKGELIDLAIDLQTTSKCTALQWLTPAQTSNKKHPYMFSQCQAINARSIFPCQDTPDVKSTFSFKLTSSLPVVASGVPVGDHEATPGKEKLYEFEQKVPIPSYLFAVASGDIATAPIGPRSIVATGPNELEGCKWELERDMEKFMEVAEKLVFPYKWGAYNVLVLPPSFPYGGMENPIYTFATPTIISGDRQNVDVIAHELSHSWSGNLVSNASWEHFWLNEGWTMYLERRIQAAIHGDAEFDFSAIIGWKDLENAVELFGKDHEYTKLIIKHEGVDPEDVYSTVAYEKGFHFLYYLEGVVGRENFDKFIPFYFTKWSEKSLDSFEFKQTFLDFFNNLGNKEVAKKITEINWEEKFYTPGLPPKPEFDTTLANQCYDLANKWKDAKFEPNANDLEEFTANQKLVFLGEVQQSGDLTADRVQLMGKTYDFMSSKNVEILSAYYQIALQAKDSAIYQAAADLLGTVGRMKYVRPLFRALNKVDRQLALDTFEKNKDFYHPICKGMVEKDLGL

SEQ ID NO: 41 - protein, 614 aa, Neurospora crassa
MAPVRDPNTLSNYDAWRTRHTTANLKIDFTAKCLRGSVILELESQTDKASKEIVLDSSYVTVNSIKLNSAPSLWETKARTEPNGSPVHIAVPEGAAKGEVVKVEIELATTDKCTALQWLTPAQTSDKAAPFMFSQCQAIHARSLFPCQDTPDVKSTYDFNITSPYVVVASGVPVPDETKDLGEEKLYKFQQKVPIPSYLFALSSGEIASAPVGKRSCVCTGPNELKASQWELEGDMDKFLEAAEKIVFPYRWGEYNVLVLPPSFPYGGMENPIFTFATPTIISGDKQNIDVIAHELAHSWSGNLVTSCSWEHFWLNEGWTMYLERRILASIHGGDAHFDFSAIRGWKALEEAIKEYGEDHEFTKLCISHKGIDPDDAFSTVPYEKGFHFVWSLDRLVGRENFDKFIPYYFGKWSNKSLDSYEFKDTFLEFFSAPEYSDLKDKIASIDWEGRFHSTGLPPKPEFDTSLADVCYELAEKWKSKDFTPSPSDVASWTGNQVLVFLNAVQDFEEPLTVEQSQALGKAYGLSESKNAELKAAYYHIAMRSKDASAYQGVADLLGEVGRMKFVRPLFRGLNKVDRELALKTFEKNREFYHPICRQMVEKDLGVSEAANSS

SEQ ID NO: 42 - protein, 613 aa, Myceliophtora thermophila
MAPVRDPNTLSNYDQWRTRHTTANFKVDFAAKCLRGSVILELESQTDKASREIILDSSYVDVSAIKLNSTPSQWVIKDRTGPNGSPVHVAVPNGAAKGEVVKLEIELATTEKCTALQWLTPAQTSNKKAPFMFSQCQAIHARSIFPCQDTPDVKSTYEFNIRSPHVVVASGVPVPGATVDAGEDKIYKFEQKVPIPSYLFAVASGDIASAPIGRCSSVATGPNELKASQWELQDDMDKFLDAAEKIVFPYQWGEYNVLVLPPSFPYGGMENPIFTFATPTIISGDRQNIDVIAHELAHSWSGNLVTSCSWEHFWLNEGWTVYLERRILAAIHKNDAYFDFSAIIGWKHLEEAIEGFGKDHEYTKLSIKHDGIDPDDAFSTVPYEKGFHFIWSLDRLVGRENFDKFIPYYFKKWQNKSLDSYEFKDTFLEFFGAPEYAGLKDKLAEIDWEGRFFNTGLPPKPEFNTSLVDVCFQLAEKWKQKDYTPSPSDISSWTGNQVLVFLNAVQDFEEPLTVGQSQNLGKIYGLADSKNAELKSAYYQIAMKAKDTSSYPGVAELLGNVGRMKFVRPLFRSLNKVDRDLALGTFEKNRDFYHPICRQLVEKDLGVGEAKSS

SEQ ID NO: 43 - protein, 662 aa, Aspergillus oryzae
MIRIPLFQPWKPRLPRGSVVHSCYFIPFSEVTTRIPWIAQASRRSMATVIHSPRDPNTLSNYNNWVSTHITATFDILFEQKKLVGNVVHKLKSITDARSTEIILDTNHVDIGDVKVDGQASHWELLPPLEPYGAALKINLDQGVGLNEMVEVEISVKTTEKCTALQWLTPAQTSNRKHPYMFSQCQAIHARSIFPCQDTPDVKSTIDFNITSPLPVVASGLPVRGIIEKAQPGSKTLYQFHQKLPIPSYLFALASGDISEAAIGPRSVVATSPDKLSECQWELKADTENFIHAIEKIVYPYAWGEYNVLILPPSFPYGGMENPIFTFATPSIISKDRENVDVIAHELAHSWSGNLVTNASWEHFWLNEGWTTYLERRILAAVHGEAYRHFSAIIGWKSLADSVEHFGHDHPFTKLVTDLKGKDPDDAFSSIPYEKGFNFLFHLENLLAKDKFDRFIPHYFTKFKGKSLDSYEFKATMLEFFQHDLEASNLLKNVDWDAWFYAPGLPPKPQFDTSLVDVVYELSSKWKSLPDSSFQPRTSDIEGLTANQIVVLLEQILLFERPLTPELSRVLGEVYSLAKSENIEVSNLYFQVGLRAGDDTVYKPTAELLGKIGRMKFVRPLYRNLQKVNRPLAIETFEKNKDFYHPICRAMVEKDLFGKREE

SEQ ID NO: 44 - protein, 664 aa, Aspergillus niger
MQPIPFTLFWRISSPRVPCFTGLKANVNSSIQVRWSLRLPQIHRRSMAISIHPPRDPNTLSNYNNWICTHITANFDILFDQKKLVGNVIHKLKSTTNGESQEIILDSNHVAIGDVKIDGRPSEWELLPPLEPYGSALKIKLDQGVNLNETIDVEISVQTTEKCTALQWLTPAQTSNKKHPYMFSQCQAIHARSIFPCQDTPDVKSTIDFNISSPLPVIASGLPVRDALGASKSEGKSLYQFHQRVPIPSYLFALASGDISEAAIGPRSVVATSPDKVQECQWELEADTEKFIGAIEKIVYPYAWGEYNVLILPPSFPYGGMENPIFTFATPSIISKDRENIDVIAHELAHSWSGNLVTNASWEHFWLNEGWTTYLERRILAAVHGEAYRHFSAIIGWKALTDSVEHFGHDHEFTKLITDLKGKDPDDAFSSIPYEKGFNFLFHLETLVGKQKFDRFIPHYFTVFKGKSLDSYEFKATLLDFFGTDAEASKLLNDLDWDTWFYAPGLPPKPQFDTSLVDVVYELAQKWKSLSETSSFKPQLSDIESLSANQIVVFLEQMLLLERPLTPELSKLMGEVYGLSKSENIEVANLYFQLGLKAGDENVVDPATELLGRIGRMKFVRPLFRSLQRVNREVAVATFEKYKDFYHPICRAMVEKDLFGKRDV

SEQ ID NO: 45 - protein, 639 aa, Aspergillus nidulans
MTTTTTTTTTTTLPFNLYGRSMATLMNPVRDPNTLSNYNNWLCTHTTANFEIFFEEKKLVGNVVHKLRSITNAETDEIILDSHHVDIRNVQVAGLPVKAWELLPPLGPYGTALKIKLENPVGLNEIIDVDIAVQTTKECTALQWLTPAQTSNKKHPYMFSQCQAIHARSIFPCQDTPDVKCTFDFNITSPLPVIASGLPVRSTSTVPQSGVKTLHRFHQKVPIPSYLFALASGDIAEAAIGPRSVVATSPDKLEECKWELEADTERFIKTIEEIIYPYAWGEYNVLILPPSFPYGGMENPVFTFATPSIISKDRENVDVIAHELAHSWSGNLVTSASWEHFWLNEGWTVYLERRILASLHGEKYRHFSAIIGWKALRDSVEHYSHDHEFTKLVPNLKGEDPDDAFSTIPYEKGFNFLFHLENLVGKEKFDRFIPHYFTTFKGKSLDSYDFKATLLDFFKSDAEASRLLQELDWDSWFYKPGLPPKPEFDTSLADVVYELAGKWRSLPESPFQPQPSDIQGLTANQIVVFLEQILLFERPLTAELSKLMGEVYGLTGSENIEVANLYLQVGLKAADKSVIGPTTDLLGRIGRMKFVRPLYRALQKVDRQVAIDTFEKHKDFYHPICRGMVEKDLFGKKDA

SEQ ID NO: 46 - protein, 614 aa, Aspergillus fumigatus
MTTVVNLPRDPNTLSNYNNWVSTHITANFDILFDQRKLAGNVIHRFRSTTDGESNHIILDTNHLDIGSVKVNGQPSEWEYLPRLEPYGTPLKIKLDQGVKLNETIEVDISVQTTEKCTALQWLTPAQTSNKKHPYMFSQCQAIHARSIFPCQDTPDVKCTLDFNITSPLPVIASGLPVRGSSEAPKSDGKTLYKFHQKVPIPSYLFALASGDISEAPIGPRSVVATSPDKLGECQWELEADTEKFINAIEKIVYPYVWGEYNVLILPPSFPYGGMENPIFTFATPSIISKDRENIDVIAHELAHSWSGNLVTNASWEHFWLNEGWTTYLERRLRHGEPYRHFSAIIGWKALTDSVEHFGPEHDFTKLITNLKGMDPDDAFSSIPYEKGFNFLFHLENLVGKSKFDRFIPHYFNKYKGKSLDSYEFKSTILDFFKDDSDASTALNELDWDSWFYAPGLPPKPDFDTSLVDVVYDLAKKWLSLPKSSFKPQPEDIRGLTANQVVVFLEQILVSERQLTPELSKLMGEIYGLAASQNIEVANLYFQVGLQAGDASVVEPTADLLGKIGRMKFVRPLYRKLAKFDRKRALDTFEKHKGFYHPICRAMVEKDLFGKKDE

SEQ ID NO: 47 - protein, 666 aa, Penicilium Chrysogenum
MGNEKWQMANGLMGEKFLSSMNPTLGRSLTRNLNFNLVRTSFKLQFTSIRTMATINPPRDPNTVSNYNNWRSTHITANFDILFDQKKLVGNVVHQFKSITDGESQEIILDTSHLDIGVVKVDGQPSKWKFLPPLEPYGVPLKICLDKPIKLNGTVEVDIEVKTTDKCTALQWLTPAQTSNKKHPYMFSQCQAIHARSIFPCQDTPDVKATFDFNITSPLPVMTSGLPIRKSSMESKADHQLYRFHQSVPIPSYLFAIASGDVAEAPIGPRSVVATSPDKLEECKWELEADTENFITTIEKIVYSYAWGEYNVLILPPSFPYGGMENPIFTFATPSIISKDRENIDVIAHELAHSWSGNLVTNASWEHFWLNEGWTVYLERRILAAIHGEAYRHFSAIIGWKSLTDAVEHFGDDHEFTKLIVDLKGKDPDDAFSSVPYEKGFNFLFYLENLVGKSKFDKFIPHYFTTFKCKSLDSYEFKALILDFFQSDAEASKLLDELDWDKWFYAPGLPPKPRFDTSMVDVVYELSKKWQSLPDSSFKPQISDIQGLTANQLVVFLEQMLLLEKPLSPETSKLMGDVYGFTKSENIEVSNLYCQVGMKAGDDSVIEPTTELLGRIGRMKFVRPLFRNLQKINRPVALATFEKYKDFYHPICRGMVEKDLFGKKDN

SEQ ID NO: 48 - protein, 533 aa, Trichoderma reesei
MWSLAVAAELLLLAGTASALLFQDLRPPKPDVDLDNNFRIAAAASTPTYGTFQQLIDHDHPELGTFSQRYVWNDEFYAGPGSPIILMGPNESALDGYERYTTNLTLPGVMAQELGAGALIIEHRYWGQSSPFDSLTTENMRYLTLEQSVQDLVYFAQNVVLPFDQNRTSTPDKAPWVLVGCSYSGALAAWVQDLAPGTFWAYQCSSPVVEAIGPLWKYFEQVKLAMPQNCTADYARIVQYIDGVLLGHNQKAKDELKASFNLGDVEHDDDFAAALVSGLYTWQSVLFSDGYSATNRMCDYVENQWPGSTAPAPGKNGVGLTKALAGYAKWFTTLSLPGSCASYGYWTNPNDTSCYDTYNASSPLFTDLSPENTGNRQWWWFLCNEPFKWWQVRGLGNLVSRLVNQPYFERQCGLIFPREGKYTYGIAQGATTARVNRVTGGWYNVNTHRLAWTAGEYDPWRPATVMAVDRPGGPLRSTKQHPVWVVPGAAHCGDMLVRNRNANEGVRNVFDSEVANIKQWVQEFYEEKGKKGN

SEQ ID NO: 49 - protein, 507 aa, Trichoderma virens
MRPRRPELEPVRLAANAATPGHAFFEQLIDHDHPEKGTFQQRYAWNGEFYKGPGSPIILMGPNESALDGFEGYTTNKTLPGVIAQELGAGALIIEHRYWGQSSPFDTLNTENMQYLTLEQSVKDLVYFAQNVVLPFDQNRTSTPDKAPWVLAGCSYSGALTGWVQDLAPGTFWAYSCSSPVVEAVDELWRYFEQVKLAMPKNCSSDYAQVIQHVDQVLLGRNQKAKDDLKALFGLADLEHDDDFAAALNNGLYTWQSVLFSDASNPLLVMCDYVENVWPGSTSPVPGAKGVGLTKALAGYAKWFTSVSLPGSCSGYGYWSNPNDTSCYDTYNATSPLFTDLTVENTANRQWFWYLCNEPFKWWQVRGQGNLVSRLVNEPYFERQCNLFFPREGKYTYGIAKGVTTHHVNQVTGGWRNVNTHRLQWTAGEFDPWRPATVMAENRPGGPLQSTPEHPVFVVPGAAHCGDMLVRNANANAGVKKIFDAQVANVKQWVQEFYEEKGGKPHY

SEQ ID NO: 50 - protein, 533 aa, Trichoderma atroviride
MRSSNPIAVAAELLLLAGAVSAGTPQDTSPPKAPVGAGVLATGSGPTYRTFQQLIDHDHPELGTFSQRYVYNGDYYKGPGSPIILVGPNESALDGYEGYTTNATLPGTYAQAVGGGAIIIEHRYWGQSSPYQSLDTENMTYLTLDQSIKDLTYFAKNVVLPFDQNRTSTPDKAPWVLSGCSYSGALTAWVQDIAPGTFWAYSASSPVVEAIGPLWQYFEQVKLAMPQNCTSDYVKIIDHVDSILLGNDKKAKADLRSLFKLEGVEYDDDFAAALVNGLYTWQNVLFADGFSATNQMCDYVENKWPNSTSPTPGAKGVGLTKALAGYAKWFTELSLPNTCSSYGYWKGEFDVDCYNTHNASSPLFTDLTPTNSANRQWNWFLCNEPFKWWQVRGEGNLVSRLVTQAYFERQCGLFFPKEGDYTYGIAEGKTTADVNKVTGGWYNVNTHRLQWAAGEFDPWRPATVMATTRPGGQLQSTAAHPVRVIPGGAHCGDQLTFNAQANAALGTIFAAEVASIKQWVQEFYAEKGGKNHY

SEQ ID NO: 51 - protein, 526 aa, Aspergillus niger
MRSFSVVAAASLALSWASLAQAARPRLVPKPISRPASSKSAATTGEAYFEQLLDHHNPEKGTFSQRYWWSTEYWGGPGSPVVLFNPGEVSADGYEGYLTNDTLTGVYAQEIQGAVILIEHRYWGDSSPYEVLNAETLQYLTLDQSILDMTYFAETVKLQFDNSSRSNAQNAPWVMVGGSYSGALTAWTESIAPGTFWAYHATSAPVEAIYDFWQYFYPIQQGMAQNCSKDVSLVAEYVDKIGKNGTAKEQQELKELFGLGAVEHYDDFAAVLPNGPYLWQDNDFVTGYSSFFQFCDAVEGVEAGAAVTPGPEGVGLEKALANYANWFNSTILPNYCASYGYWTDEWSVACFDSYNASSPIFTDTSVGNPVDRQWEWFLCNEPFFWWQDGAPEGTSTIVPRLVSASYWQRQCPLYFPEVNGYTYGSAKGKNSATVNSWTGGWDMTRNTTRLIWTNGQYDPWRDSGVSSTFRPGGPLVSTANEPVQIIPGGFHCSDLYMEDYYANEGVRKVVDNEVKQIKEWVEEYYA

SEQ ID NO: 52 - protein, 525 aa, Aspergillus fumigatus
MRTAAASLTLAATCLFELASALMPRAPLIPAMKAKVALPSGNATFEQYIDHNNPGLGTFPQRYWYNPEFWAGPGSPVLLFTPGESDAADYDGFLTNKTIVGRFAEEIGGAVILLEHRYWGASSPYPELTTETLQYLTLEQSIADLVHFAKTVNLPFDENHSSNADNAPWVMTGGSYSGALAAWTASIAPGTFWAYHASSAPVQAIYDFWQYFVPVVEGMPKNCSKDLNRVVEYIDHVYESGDIERQQEIKEMFGLGALKHFDDFAAAITNGPWLWQDMNFVSGYSRFYKFCDAVENVTPGAKSVPGPEGVGLEKALQGYASWFNSTYLPGSCAEYKYWTDKDAVDCYDSYETNSPIYTDKAVNNTSNKQWTWFLCNEPLFYWQDGAPKDESTIVSRIVSAEYWQRQCHAYFPEVNGYTFGSANGKTAEDVNKWTKGWDLTNTTRLIWANGQFDPWRDASVSSKTRPGGPLQSTEQAPVHVIPGGFHCSDQWLVYGEANAGVQKVIDEEVAQIKAWVAEYPKYRKP

SEQ ID NO: 53 - protein, 547 aa, Neurospora crassa
MRFFSAATALLAAASTAHAAFFKTLGMEIGPIDDHIESLNKRAEVEGTSGYGTFDQLIDHNTPELGTFKQRFWYGFQYWKGPGSPIILVNPGEQAADGFNKSYLSDQRLAGWMAKDMGAAVVIMEHRYWGNSSPFDELTVKNLQYLTLENSLKDINYFAEHIDLPFDKTNGSKPANAPWIFSGGSYSGALAGWLEALYPGTFWAYHGTSGVVETLGHFWTYFVPVLEATPQNCTKDLTAVIDYVDSVLLHGTPKAKRELKSKFKLQNLTDADFASAIESGPWSWQSTQFYSEKITGYNPYYRFCDYVENVWPNSTNKVPGPLGVGIKKALDGYAKWFVEESLPGTCESSGYDAFKGEDNVLCFQNQNASNPIFHDLSVDNAYNRQWNWFLCNEPFEWWQDGAPLGRPSIVSRLVDADYWRKQCPLWFPAEKGSNATYGIKQGKRAEDVNKWTGGWKHTNGTRIMQANGSLDPWRDVTLSSKFRPGGPFKGNKNHQVRVIEGGTHCSDFYGPNWSANEGIKKVAEEEVAQMGQWVADFYKKRGITRTR

SEQ ID NO: 54 - protein, 544 aa, Myceliophtora thermophila
MRLSITALAAGLAFAPLAAAFGRGLIMDIGPDDDTVSETELQKRAETVNGWGTFDQLIDHANPSLGTFKQRYWYGTEYWKGPGSPIYLVSPGEQSGEGFNRTWLTTARLSGVMANQTGGAVIVLEHRYWGQSSPYDELTVENLRYLTLDNSLKDLVYFAKNFAPPFDPSGSSSADKAPWIFAGGSYSGALAGWLAAREPGTFWAYYSSSGVVEAIGDFWQYFVPVQEATPKNCSADVGAVINYVDLVLSFGSKKSKQALKDKFGLGELEDADFAAALEWGPWEWQSGQFYSFNTTGYNPFYRFCDYVENVWPNSTNKVPGPRGVGLTKALEGYAKYVKEQVIPGFCESAGYPEWEGENNIACFKNLDPNNAAYKDLSLDNWINRQWNWMLCNEPFEWWQDGAPLTRPTLVSRLVNADYWRKQCPLHFPEGGYGIAAGKRAKDVNRWTGGWSVTNTTRAMHTNGQYDPWRDATLSSKFRPGGPVQSTERLPVRLVKGGTHCSDLYGQNWAVNEDVKKLAQDAADEMTGWVGEWYEEKGLPKPWAA

SEQ ID NO: 55 - protein, 538 aa, Myceliophtora graminicola
MHLLNSLAAIAVFLQHGQGLSLKQEARFETPAKAQLHARQADSTAGVVDGVFHQLVDHDNPSLGTFEQRYWYSLNYANGSNPPVVFISPLDAEAEQVKFWLHDDYVIGGMIARRIGAVMIMLEDRYFGKSSPYDQLTTENMKYYTEDQMVRDKIHFAKTAELPFAKNGGSRPDQVPWVHTGCSAQGNRVMFSQKESPDTFWASWASSAPPQAIPNYWRYFDAAKAYLPKNCTADVEKVIEHLDDVMLNGSADDIQKIKTDFGAPDLKHNDDFMNLLNYGPQTFQGASLRIGDTWQFCDYVENAVDTTDKSKLPGAEGVGLDKALKGYARWTKEVWIPGRCEQQGPWKGENNTGCFNFGDADSLVYATKGLDAPSIVDTLQAQWLFCNEPDENWQTGSPKGTPTLVSRLVNTDYFRKTCARYFPTGPNGETFGLAKGKTADIWNTRYGGWSDPIGYLNRTVLVNGKFDPWRAASFASDQRPGGILGNSTYVKHFINPMGNHCTDTYRNAGSIWPEVKAVQEAGIKQIEKWIAMFPKHKV

SEQ ID NO: 56 - protein, 548 aa, Myceliophtora thermophila
MKVSARAILPFAPWIAAKAAVIRSAPDGTPLSESAQAVVRAAGPGATCEWFTQPIDHKNASHKSWQQIYCVDPQWWTPGAPVVLMTPGGEPITWAVNSARGFSYLKNTTLAGRYAQELGAAAVVVEHRYFGGSSPYDGFDAETLQYLTLEQAAADLVNFAQNVTFPFDKEQTSVASKVPWVYWGSSYSATLGSWIEHLHPGVFHAYHLSSATVQANTENWYYYDTIRKGIDALRNDTRCSAALEEVVGFVDRFLLASPVNETQMDALKQYFGAVFPIANDDFAYAIATPFRYWEERGGYRAVLDMCDGIVGSDATEEHEVLGTIPSSVGNYAAYFQMNFRDSTCTYLDVWGQKDPLWCLDTHDPLNPFIEARTLGNPWRTRMWFPCNEPLASWATGAPRDRPSLVSRRLDAAYWQAQCEMHFPAVGDHRYGSADGLRTPDTLNAVTGGWARRSKRVIWTVGLEFDPWRATSMASELRPGGPLESSGDVYVFVIKNAAHADDALTEAGLANLNLPVNPEVVKVQQQSVGIVKEWVGQFRPGGDEEGSDE

SEQ ID NO: 57 - protein, 537 aa, Fusarium graminicola
MARGWFVNCAAVLLALTAGVDAYTVPALSARAKDSGPKAVNISVPVDHFHNETIYEPHSDKKFPLRYWFDAQYYRKGGPVIILASGETSGEDRIPFLEHGILQMLANATGGIGVILEHRYYGTSFPVPDLKPENMRFLSTEQALADTAYFAQHVEFPGMEEHNLTASTTPYIIYGGSYAGAFAAFARKIYPDLFWGGISSSGVTEAIVDYWQYFEAARLFAPGDCAKVTQKLTHAVDNILLGDDKEEKKQLKIAFGLLGLRDDDFAMTISQGIGGLQSNNWDPASDSSSFGLYCGSVSSDDILFASTRPLAPYVKKWLISAGYKKQLKYMTNRFLNYIGYIRSNVESDKSGRCDGKTLDQCYSIRGSMNDTKLDPNNMSRQWTYQTCTQWGYWQTGSGAPKDQLPMVSRLIDVEYNTIPCREEFNITTPPNVESINKLGGFNFSYPRVAFIDGEYDPWRAATPHAIGLPERESTASEPFILIPYGVHHWDENGLAPGSEEIGLPPPAVKQAQQDIIDFTKAWLEDWEKEKGGATADL

SEQ ID NO: 58 - protein, 569 aa, Aspergillus niger
MFLSLPLLGTLIASTVALDSSPLELRVPHLHQLSQLSKSHQASLNQDSASFPVYNLSVPIDHFHDESRYEPHTNATFGLRYWLDTSHYQPGGPVFVIAAGETDGSDRIPFLSQGVVTQLAAAYHGIGLILEHRYYGESYPFTNLTTENIRFLTTEQALADYAYFASNIVFPGLEDLDLTAATTPWIAYGGSYAGAFVAFLRKLYPELYWGAVSSSGVTEAIIDYWEYYEPIRLYGPSQCISTIQTSIDIVDRILIDHADNKTLAQQLKSAFGGSATNLSNQDFVSSLSYGLDSFQSRNWDKTIGTPLFRAFCNNITNSDLLYPEAAEPISASVKQLVQIAGYDPSNTTLVNNFLNWIGFLSTSKVFADSSSESSSSNITNFTTPQPLSKDSGTSWNYQVCVEWGYFTTGSSVPSTTKPLISRLLDLPYLSSFCPNTFGIKTPPDVQRINQFGGFNFSYPRVAIIGGLADPWRDATPLADGVDWQSRKSSDSEPIILLDIPAADVWDGVRGAVHHWDQNGLSGQQKKEGEKAPKEIVSVHEEVVRFVGVWLKEWKGKQSDADERVYQTVL

SEQ ID NO: 59 - protein, 561 aa, Myceliophtora thermophila
MLRGTIAVGVACLAQLVAGLDGPLFRTSLTLRDFREQLERRQARDGAALEARSSDLQDLYPAHTLQVPVDHFHNDSLYEPHSSETFPLRYWFDASHYKKGGPIIVLQSGETDGVGRLPFLQKGIVAQLARATNGLGVILEHRYYGESIPTPDFSTEKLRFLTTDQALADMAYFARHVVFKGLEHLDLTSAKNPYIAYGGSYAGAFVAFLRKLYPDVYWGAISSSGVPEAIYDYWQYYEAARIYAPHDCVVATQKLTHIVDNILLDKADTDYVRRLKTGFGLGGVTRNDDFANAISWGIGGLQGLNWDPALNDTGFGEYCNNLTATKPLYPTSPALEQEARELVKAGGYGKEADTLTTQLLNYMGYVNATTVQTCHKDSQDECFTNYNSTFYQQDDKTQDWRLWPYQYCFEWGYLQTGSGVPANQLPLISRLIDLNFTSVVCREAFNITTPSQVERINKLGGVNISYPRLAFVDGERDPWRYASPHRIGLPERKNTISEPFILIKDGVHHWDENGLFPNETRPGLPPKPVADAQRAEVKFVKAWLKEWKEKEKCRGRKFCWP

SEQ ID NO: 60 - protein, 561 aa, Neurospora crassa
MMGLGRLLAATACVAQLASALAPAFAPLSVRNLRLSSESDLALEPEGDFTIQESTDPTLLYPARTIKVPVDHFHNDTKYEPHTNDTFDLRYWFDATYYKKGGPVIVLAAGETSGVGRLQFLQKGIVYQLAKATGGVGVILEHRYYGKSLPTSDFSTKNLRFLTTDQALADTVYFAKNVKFAGLEHLDLTAPNTPYIAYGGSYAGAFVAFLRKLYPDVYWGAISSSGVTEAIYDYWQYYEAARIYGPKDCVTATQKLTHVVDNIILNKANARYVQKLKDTFGLGNLTHTDDFANTISFGIAGLQSTNWDPALNDTSYGEYCNNVSSNALLYPETARLEKDVQELLTVGGYGKEVKTLTNQFLNYIGYVNVTSVQSCDGDQNACFTSYDSEFYKKDDLKQTWRLWLYQVCDQWGFLQTGSGVPHNQLPLISRAIDLNYTSIACREAFNINKPSDVESINKYGGFGISYPRLAIIDGEKDPWRAATPHAIGLKDRKSTISEPFILIKDGVHHWDENGLFPNETAPNFPPKPVEETQRAIKNFVQAWLQDFKKSGHGHGHGSTKP

SEQ ID NO: 61 - protein, 572 aa, Aspergillus fumigatus
MQLQAVLFLIGTFLASAAQGFDISPLELQFPLLHQLRLLEDETGASLHLTSLKEFVDHNFSVPIDHFHNESRYEPHTRDHFNLRYWFDASHYKEGGPVFLIAAGETNGRDRFPFLSHGIVTQLAKTYNGLGVILEHRYYGESYPFADLTTKNIRFLSTEQAMADYAYFASNVVFPGLEHLNLTADAVPWIGYGGSYAGAFVAFLRKVYPEVFFGVVSSSGVTEAIVDYWQYYEPIRQFAPSDCIWSIETFMDIVDTILIEHAKNETLKSHLKAVFGATSSDVDDEFFAAALSSTLGAFQGRNWDPAVGDGTFQRYCKNLTSPSLLYQQNNTMKAWTEEVISATKYDATNSSLVTGMLNYAGYMNATMFSHLDEVRGTSSHKSPQSLQKSSGVSWGYQVCTEWGYFMPGSSVPKDRLPLISRLITLAGESRFCKEDFNITTPPDTDRINKHGGFNFSYPRAAIIDGLADPWRDATPHADGTRPRQSTDEEPFILVDVPAEDVWDGIRGAVHHWDQNGLSEQDVQQGKTAPKAIVALQQEIIRFVGVWLKQWRKHEDVSDPTANTAVRNRQLVL

SEQ ID NO: 62 - protein, 566 aa, Aspergillus oryzae
MVSLTHIFSKALLTLLVGQSAALSFLPGIKANNLQLASVLGIDGHTARFNPEKIAETAISRGSGSEVPARRISIPIDHEDPSMGTYQNRYWVSADFYKPGGPVFVLDAGEGNAYSVAQSYLGGSDNFFAEYLKEFNGLGLVWEHRYYGDSLPFPVNTSTPNEHFKYLTNSQALADLPYFAEKFTLNGTDLSPKSSPWIMLGGSYPGMRAAFTRNEYPDTIFASFAMSAPVEARVNMTIYFEQVYRGMVANGLGGCAKDLKAINDYIDSQLDKKGQAADAIKTLFLGKEGIHNSNGDFTAALGSIYNLFQSYGVDGGEESLSQLCSYLDKEASPNGIARKIGVKELTEKFAAWPPLLYLINQWGSQVGNGDSNCKGQNNSTETVCELGGQFTDPDTISWTWQYCTEWGYLQADNVGPHSLLSKYQSLEYQQSLCYRQFPGAKESGLLPEHPEANETNAETGGWTIRPSNVFWSAGEFDPWRTLTPLSNETFAPKGVQISTNIPKCGVETPENVLFGYVIPRAEHCFDYDLSYKPADKSRKLFSLALKKWLPCWRSEHAPKGVQRKWM

SEQ ID NO: 63 - protein, 557 aa, Penicilium Chrysogenum
MHFSTVVKGIATLTALSGTAAGIVTSQFKRDLKLSAELGIHPDTLLGQKTTVHDVTNSQLDETIEAEYVSIPIDHSNSSVGHYRNRYWVSEEHYKEDGPIFVFDVGESTAEPAGQTYLSNSSTFFYQLVKEFGGIGIVWEHRYYGDSLPYNVSLDMEPEHLQYLNNKQALADIPYFAAQFTRQDYSDVDLTPAGTPWVMVGGSYAGMRAAFTRQSYPDTIYAAFASSAPVEARIDMSVYFDQVYDGMVTYGHLNCTRDIKAALEYIDEQLSKSESAAAAIKREFFGEGAEKNSNGDFTAALVTIYNFFQSYGMGGGVGSLESFCEHMETDPKTSAAAPSEGFAPTRGKKYVAERYASWPVFTQVVNMNMKTNCKKLETSEPLECDLGPPSANPDTISWTWQYCTEWGYFQTNNFGAHSLLSKYQTLEYAQEYCNRFFPEAVAKGLFPKHPQTEATNAETGGWSIRPSNVYWSGGQFDPWRTLSPLAETRLGPQGVTLTTEIPKCNVETEENTIFGYIMQKAEHCFDFHTAFVPGAISRGYFQTALKEWLGCFKAKTR

SEQ ID NO: 64 - protein, 573 aa, Aspergillus oryzae
MHSSLKLLLSAASLLPLAQAFQYTPLQLAYPELRAKQQLTPESAVKQQSTTAEYPEYYLSVPVDHFHNDSRYAPHSDDHFDLRYWFDAQYYKEGGPVFVIAAGETDATDRFPFLSQGIVTELASAYNGIGVILEHRYYGKSYPVANLTTENIRFLSTDQALADYAYFASNVVFPGLEHVNLTSKTTPWIAYGGSYAGAFVAFLRKLYPDVYWGAVSSSGVTEAIIDFWQYYEPIRKFGPSDCIWSTQTFIDVVDRILIDHADNKTLGQQLKTSLGVSPDKDDVSFVSLLSSGLDSFQSRNWDSNIGSYSFRSYCDNITSSDLLYPDTEAVKPTIQELIEVAGYDATNSSFVNGFLNHVGLFKKSITSDEDSAETEQSDSSDPKSLPKDDGTSWEYQVCTEWGYFMSGASVPKDIMPLISRVLDVASVSTFCETTYGITSPPNVTNINKHGGFNFSYPRVAIIDGLADPWRDATPHADGTKERESTDDEPFILIDVPAEDVWDGIRGAVHHWDQNGLSKTDEGKGQEPPAAIVEVQKEVLRFIGVWLDQWKKRSRDSSRPLGGIRGPGRSQVPL

SEQ ID NO: 65 - protein, 557 aa, Aspergillus nidulans
MRFNPLISTAFVASLASFASGLGLRSDLAKSLQLAAELGLDSDLLLKDSQSFRTAVTQTNPPAEYVLVDSRFLMTMCTGSNALQLPIDHHNPAIGTFRNRYWVNDAYYVPGGPVVLYDVGEADGEPSVAHLRSNSSFLPPILQEFGAIGIVWEHRSVVSTKVETRIEIDRNRYYGDSLPYPVNNNTLPEHLIYLTTRQALADIPAFAENFTRPGLQEYDLTPASTPWVMIGGSYPGARAAFARNEYPDTIFASFAASAPVQAQINMSIYYEQVYRSMVANGFRSCASNIHAALEYIDNQLSQNDTAASIKQLFFGPGAEKNSNEDFTHALAVIYGSFQAYGMDGPAGSLGEFCRYLESDPVTGQPAETEGLALRHGYKHLAERWAEWPIFTQLINVNYETNCKGLDKSVAPSCELNKPTTNPTAIAWTWQYCTEWGFYQSNNEGVHSLLSRYQTLEFQQVMCNRQFPEAVKNGLLPPQPRVDALNAEFGGWNIRPSNVYFSAGEFDPWRTLTLLSGEQFSLQLNVTSDVPRCGVRTGPDTVFGWAPCGRMSSQHSIL

SEQ ID NO: 66 - protein, 562 aa, Aspergillus niger
MPSYSATIAAIGAFLLSQPVMGSRQGKAPFGWGTQSLAHFGINPDLGLHNQQNLNSLISHSAMATALETEYATIPIDHNNASAGTYQNRFWVSDEFYQPGNPIFVYDTGESDGGSIAQSYLTSTLSFFREFLIEFNAMGIAWEHRYYGNSTPAPVSYETPPEAWQYLTTKQALADLPYFASNFSREKYPDMDLTPQGTPWIMVGGSYAGIRAALTRKEYPETIFAAFSSSSPVEAQVNMSAYYDQVYRGMVASGWTNCSADIHAALEYIDDQLSDEDTATSVKQLFFGSGAETNSNGDFTAALTAIYGYFQSYGMAGGIGGLGAFCEYLEIDPKTNGTTGPDGLAPTYGGQYVAERWAAWPTFLELVNLNMGTNCGPQDASQPIDCDFSKPYGDPSAITWTWQYCSEWGFFQANNDGPHSLASRYQSVEYQQEVCNRQFPDAVDKGLLPPSPRADDVNQEFGGWTIRPSNVYFSGGEFDPWRSLSILSTEDFAPQGVEFTSAIPACGVQTNEDTVFGYVMQNSEHCFDFQATPTVGKLSRGIFTSALLQWLECFGQNSSQSR

SEQ ID NO: 67 - protein, 541 aa, Aspergillus oryzae
MVSLTHIFSKALLTLLVGQSAALSFLPGIKANNLQLASVLGIDGHTARFNPEKIAETAISRGSGSEVPARRISIPIDHEDPSMGTYQNRYWVSADFYKPGGPVFVLDAGEGNAYSVAQSYLGGSDNFFAEYLKEFNGLGLVWEHRQALADLPYFAEKFTLNGTDLSPKSSPWIMLGGSYPGMRAAFTRNEYPDTIFASFAMSAPVEARVNMTIYFEQVYRGMVANGLGGCAKDLKAINDYIDSQLDKKGQAADAIKTLFLGKEGIHNSNGDFTAALGSIYNLFQSYGVDGGEESLSQLCSYLDKGASPNGIARKIGVKELTEKFAAWPPLLYLINQWGSQVGNGDSNCKGQNNSTETVCELGGQFTDPDTISWTWQYCTEWGYLQADNVGPHSLLSKYQSLEYQQSLCYRQFPGAKESGLLPEHPEANETNAETGGWTIRPSNVFWSAGEFDPWRTLTPLSNETFAPKGVQISTNIPKCGVETPENVLFGYVIPRAEHCFDYDLSYKPADKSRKLFSLALKKWLPCWRSEHAPKGVQRKWI

SEQ ID NO: 68 - protein, 612 aa, Trichoderma reesei
MAKLSTLRLASLLSLVSVQVSASVHLLESLEKLPHGWKAAETPSPSSQIVLQVALTQQNIDQLESRLAAVSTPTSSTYGKYLDVDEINSIFAPSDASSSAVESWLQSHGVTSYTKQGSSIWFQTNISTANAMLSTNFHTYSDLTGAKKVRTLKYSIPESLIGHVDLISPTTYFGTTKAMRKLKSSGVSPAADALAARQEPSSCKGTLVFEGETFNVFQPDCLRTEYSVDGYTPSVKSGSRIGFGSFLNESASFADQALFEKHFNIPSQNFSVVLINGGTDLPQPPSDANDGEANLDAQTILTIAHPLPITEFITAGSPPYFPDPVEPAGTPNENEPYLQYYEFLLSKSNAEIPQVITNSYGDEEQTVPRSYAVRVCNLIGLLGLRGISVLHSSGDEGVGASCVATNSTTPQFNPIFPATCPYVTSVGGTVSFNPEVAWAGSSGGFSYYFSRPWYQQEAVGTYLEKYVSAETKKYYGPYVDFSGRGFPDVAAHSVSPDYPVFQGGELTPSGGTSAASPVVAAIVALLNDARLREGKPTLGFLNPLIYLHASKGFTDITSGQSEGCNGNNTQTGSPLPGAGFIAGAHWNATKGWDPTTGFGVPNLKKLLALVRF

SEQ ID NO: 69 - protein, 439 aa, Neurospora crassa
MVALTNLLLTTLLASAGLGAALPPRIGSTVIEAREPELPVSGRKITLPQQKNPRFHKFNGALSVYKTYLKYGAPVPDHLVQAVANHLGISVEEVHNYANTTANARRDQGSATAAPIDQSDSAYITPVSIGTPAQTLNLDFDTGSSDLWVFSNSLPSSQRAGHTIYNPSKSSTAKRVNGASWDISYGDGSSSKGQVYLDKVTIGGLVVSNQAVETAQQVSQSFTAETSIDGLVGLAFGSLNTVRPRQQKTWFENAIGQLDQPLFAADLKYEASGTYDFGFIDPAKHTGDITYVPVNTNPGYWTWTSTGYQVGSSPFVSQSITNIADTGTTLMYVPDSILRAYYGQIRGATNSQSYGGYVFPCSTEAPDFTFGVTDEATITIPGRFINYGPVTDDGETCFGGLQTSSDVGINIFGDVALKAAYVVFKGGDSPSLGWASKQL

SEQ ID NO: 70 - protein, 417 aa, Myceliophtora thermophila
MHLTPALVAATCAVEVCAGVLPRSSSTPTTFGSGTLSLKQVRNPNFVRNGPVQLARIYHKYGVPLPHDLREAVARFRAEIRKRSNGSTETNPETNDVEYLTPVSIGTPPQVLNLDFDTGSSDLWVFSSETRSSDVQGQTIYDPNESSTAQKLQGYSWQISYGDGSSSSGDVYTDAVTVGGLTVPSQAVEVARRVSDEFTSDPNNDGLLGLGFSSINTVQPVPQKTFFDNAKADLDAPIFTADLKASAPGFFNFGYIDHGAYTGEITYMPVDSSDGFWAWTSPGYAVGSGSFKRTTIQGIADTGTSLFLLPSSVVSAYYGQISGAKYDSIQGGYTLPCSGSVPDFAFGIGDSNTTISVPGDYVRYAATDSSGIICFGGIQANTGIGFSIFGDVALKAAFVVFDGAKQQLGWASKPLPS

SEQ ID NO: 71 - protein, 434 aa, Neurospora crassa
MLLFPTILTAALAATGMAAAIPSRDDTTANKGTASLLQVRNPSFEFRHGPLALAKAYQKFGAPMPEDLRAAIARFRQNQKRTTGTIATDPEKHDVEYLTPISVGTPSQDLVVDFDTGSSDLWVFSTEMSTSDIKGQTVYDPNNSSTSEKVQGSTWKITYGDGSSSSGDVYLDTVTIGNLTVPSQAVEAAKKVSSEFTDDSHNDGLLGLGFSAINAVEPTPQNTFFDNIKGSLDAPLFTVDLKHGTPGSFNFGYIDPAAYIGNISWTPVDSSQGYWGFTSPGYAVGTGAFRNHSISGIADTGTTLLLLPKSVVSAYYKEIQGAQYDSDQGGYIFPCSPTPPDFVFGVNKGIVTVPGDMVSYAPADSANQNCFGGIQTDTGIGFSIFGDVALKTSFVHLHGSIVPGYYADCAMRFNRMLRSYSNDQLVDFSSSGPL

SEQ ID NO: 72 - protein, 466 aa, Myceliophtora thermophila
MDALFETHAKLRKRMALYRVRAVPNQNYQRDGTKSYVSVLNRFGFQPTKPGPYFQIFEESEEAPSMSAAPGVKPGHVWQGLFKKLKDQEEPGEVTAEDQQNDSEYLCEVMIGTAWTAERQIVKMDFDTGLADFWVSQKSFDPKKSVTWQLAKDKSWKVQYGDGSSASGIVGHDILIIGGIQIKRQAIEIATEMSAQFSEGTMDGILGLAFSKLNTVQTDGKPDPQRTVVDNMMAQDDIPPEAELFSTALYSNREDDQRSFYTFGWIDEDLVKASGEEIVWTDVDNSEGFWMFSSEHVTIDGQQVRIEGNKAIADTGTSLVLVSDQVCDALYAHIPSAEYSEEYQGWTFPQETEVDKLPEFSIAIGDKEFVLQKEDLIFAPADERVFYGSVQSRGENPFDILGIAFLKSIYAIWDQGHKRFGAVPKMEAFVPPTKYDRPRLTDQDRKDLGVTIGYGDISSTFFEKRA

SEQ ID NO: 73 - protein, 481 aa, Neurospora crassa
MGSMYQVQSKLRQDLGLHKVQAVRKPGRELNGTKAYVSAMARYGFNPTEESRFFHLKKTDLTKEFQRRGYIRHWEQLVRTPQERPDDPHTDNEPVPAEDQQYDTQYLCEIGIGTPQQKVKLDFDTGSADLWVRCTDSSLLHHADKKFDPKKSDTFQESKTDQTWKIQYGDGSTASGTVGTDVITVGGLQIKNQAIELAKKVSSAFSSGEADGLLGLAFSTINTIESDGKPDPQPTPVENMISQEDIPKEAELFTSAFYSARDDKSEEKSFYTFGWVDEDLVKASGKDITWTPIDNSEGFWKFPSESATVDGDNVSVSGNTAIADTGTTLALVSDTVCKALYAKIPGSKYSYRYQGYLIPSTITADQLPQLSVAVGGEQFVIQNEDLLLAPADDDHWYGGVQSRGTMPFDILGDTFLKSIYAIWDQGNNRFGAVPKIEVNQHTVFPDTEPSPEASSPEPADKVGDVSPVEQVKGAVKSLKVL

SEQ ID NO: 74 - protein, 397 aa, Myceliophtora thermophila
MKDAFLLTAAVLLGSAQGAVHKMKLQKIPLSEQLEAVPINTQLEHLGQKYMGLRPRESQADAIFKGMVADVKGNHPIPISNFMNAQYFSEITIGTPPQSFKVVLDTGSSNLWVPSVECGSIACYLHSKYDSSASSTYKKNGTSFEIRYGSGSLSGFVSQDTVSIGDITIQGQDFAEATSEPGLAFAFGRFDGILGLGYDRISVNGIVPPFYKMVEQKLIDEPVFAFYLADTNGQSEVVFGGVDHDKYKGKITTIPLRRKAYWEVDFDAISYGDDTAELENTGIILDTGTSLIALPSQLAEMLNAQIGAKKSYTGQYTIDCNKRDSLKDVTFNLAGYNFTLGPYDYVLEVQGSCISTFMGMDFPAPTGPLAILGDAFLRRYYSIYDLGADTVGLAEAK

SEQ ID NO: 75 - protein, 396 aa, Neurospora crassa
MKGALLTAAMLLGSAQAGVHTMKLKKVPLAEQLESVPIDVQVQHLGQKYTGLRTESHTQAMFKATDAQVSGNHPVPITNFMNAQYFSEITIGTPPQTFKVVLDTGSSNLWVPSSQCGSIACYLHNKYESSESSTYKKNGTSFKIEYGSGSLSGFVSQDRMTIGDITINDQLFAEATSEPGLAFAFGRFDGILGLGYDRIAVNGITPPFYKMVEQKLVDEPVFSFYLADQDGESEVVFGGVNKDRYTGKITTIPLRRKAYWEVDFDAIGYGKDFAELEGHGVILDTGTSLIALPSQLAEMLNAQIGAKKSWNGQFTIDCGKKSSLEDVTFTLAGYNFTLGPEDYILEASGSCLSTFMGMDMPAPVGPLAILGDAFLRKYYSIYDLGADTVGIATAKR

SEQ ID NO: 76 - protein, 454 aa, Myceliophtora thermophila
MKFAALALAASLVAAAPRVVKVDPSDIKPRRLGGTKFKLGQIHNDLFRQHGRGPRALAKAYEKYNIELPPNLLEVVQRILKDLGIEPHSKKIPGSKSSYGNGAPYTNETDDSGEVSAIPQLFDVEYLAPVQIGTPPQTLMLNFDTGSSDLWVFSSETPSRQQNGQKIYKIEESSTARRLSNHTWSIQYGDGSRSAGNVYLDTVSVGGVNVFNQAVESATFVSSSFVTDAASSGLLGLGFDSINTVKPTKQKTFISNALESLEMGLFTANLKKAEPGNYNFGFIDETEFVGPLSFIDVDSTDGFWQFDATGYSIQLPEPSGNITGTPFRAVAHTAIADTGTTLLLLPPGIAQAYYWQVQGARQAPEVGGWVMPCNASMPDLTLHIGTYKAVIPGELIPYAPVDTDDMDTATVCYGGIQSASGMPFAIYGDIFFKAQFTVFDVENLKLGFAPKPEL

SEQ ID NO: 77 - protein, 489 aa, Myceliophtora thermophila
MAIPVLFSALVLLVALLCCHATAALQQLAHDVGCVHLPVVHSTKVDRFSDKRGIQLQLANRSDVAYYAQLSIGTPPQPVFVQLDTGSFELWVNPDCTTVSGSDAVFCERAGRYDVTKSSTATSLGTNRTLRYGIGAANISYFTDTISLAGSPMMLQDVQFGVATASEDAFSGILGIGYGKGIGTGYPNFVDQLWEQNVTRVKAYTLALGSKDSQEGVIVFGGVDTSKFAGKLARLPVIPPAQSPDGVPRFWVEMKSLSITRPSGLNTVYDGGAMPVFLDSGSTMTLLPANLTMAVARDFGAQAPDANGFYKIDCALTALNGTLDFAFDGVTVRVPYKELTREVASNPPSCFLGIVASDRFTLLGDTFLRSAYTVFDLETDSIWMAPAVNCGSSPAALSNVQDLSAVTGECGVREIAESTSSTQVPSTGVDDTEAGAVPTSTTTVVSQPSGTTTQMGARPTLDNASNPLGAHRLTWVLVITAALHLFTGI

SEQ ID NO: 78 - protein, 518 aa, Neurospora crassa
MAAFPFLSASFVLLQLALTCLAQHLNLTTGPLHLTGHTPGDGCVHLPIIHSTNTDHFARRGIQLALNNRSDVAYYAQLEIGTPPQTVYTQLDTGSFELWVNPDCTTVSPSDSSFCDHIGFYNASLSSTSKSLGTSKTLRYGIGAANISYVTDTISLSGSSTSLKDIQFGVATSSKDAFSGILGIGYGQGLATKYPNFIDQLYAQKITKVKAYTLALGSKTAQQGSIVFGGVDTSKFAGPLGRLPIIPAEDSPDGVPRFWVQMNGISLTPPSGQSMGVYEGSKIPAFLDSGSTMTILPPALANKIAEDFGSPEMDANGFYRVGCGYVEMNGTMDFEFVGAGQKVTVRVPYKEMIREVGQGESKMCFLGIMGSESFTLLGDTFLRSAYATSCGNTPAALRDVTDLSRVVGNCQIQLGEKEAVVDVVSETSIAPPTGSTGDTDGVTGTGGNGSGNGGTRTAWGFVTTTLAVPMATGLAGVGGSGSGSMSATALDSSGRSMAGDVVLSAAVAVGAAVLGSLL

SEQ ID NO: 79 - protein, 501 aa, Myceliophtora thermophila
MRGYAAVAFGAILAGAVHASAGNGVVQWDIRRTQRQEELQRLNRRLRKRANPVLEVITNEKIRGGYFATCKIGTPGQDLTLQLDTGSSDIWVPDSAAQVCREIGTEGCALGTFNPNRSSSFEVIGEGQFDIEYVDGSSSKGDYFTDVFQIGDISVQNMTMGLGLHTDIAYGLVGVGYAINEAIVATTQSRDSVYPNLPVQMVDQGLINTVAYSLWLNDLDASSGSILFGGIDTEKYQGELTRIDIYPTSQGDFSSFVVALTSLEARSPSGQDTLTSQEFPIPVVLDSGTTLSYLPTDLATQAWKEVGAFYLPEVGAAVLPCDMENSKGSFSFGFAGPDGPRITVGMDELVLDMTDGQAPQFLSGPYKGRDVCQFGIQNFTSAPFLLGDTFLRSAYVVYDLVNNQIGIAATDFNSTDSNIVPFPSMGAPIPSATVAANQREVTRVPTVTEPAYSASQGFMESASGEESLAPGMPAAWGMGQLLVVGVTMALTALGSGLFFVL

SEQ ID NO: 80 - protein, 492 aa, Neurospora crassa
MKGYTSSALLLGPALLSQLALAQQAPNGVVHWGIQKRHAPNAPNRLLRRAGPTHQAILQNEQARGGYFATCAMGTPGQKVTLQLDTGSSDVWVPDSTASICNKGACDLGSWQGEFDISYVDGSSSKGDYFTDVFNIGGTTVTNLTMGLGAQTDIAYGLVGIGYAINEAIVGNSHSLSSQYPNLPVAMVDDGLINTIAYSLWLNDLDAGEGSILFGGIDTKKYKGDLTRIRIYPSSNGYYFSFIVALTSLQAISPSGNDTLTSQEFPIPVVLDSGTTLSYLPQDIVDQIWQEVGAEYSDRLELAVIPCSKKSSNGYFSFGFAGPDGPRITVRMDELVLDLTSGDPPKYTSGPNKGQDVCEFGIQNSTSAPYLLGDTFLRSAYVVYDLVNNEIGLAETDFNSTESNIVAFASMSATIPSATQAPNQAAVTNRPVATMPSFAASSGFSDTGGSGNDGKDENASAGMPSAFGVAQMSVMGIAMVFAMVGSGVFVLL

SEQ ID NO: 81 - protein, 668 aa, Myceliophtora thermophila
MSFALYAAALLPVAVLGAGLSVPEDNRMVQQDGLLRYPLMPRLGNLLFGKHANITRRQIDTGIFDPLSGTLYTIELTLGTPGQTVPVQFDTGSDMLWVNPVCSKAAEPEFCAAQPRFTDSSTLVDFGEQGNITYGTGYAYYEYVADYVAIGSARITQQVFGVALDSAHADVGIFGAGPNLDGWDSAYPLVVDSLAQQGYTSSRAFSMDLKGFESARGSVIFGGIDTKKYRGSLIKRLIIPAAESPDGYTRFWIYLDGISVNQPDGDVVTVFSTPDGGKGQPVLLDSGYTLSALPRPIFQKLVAAFPSAQYVSSADVYVVDCVDHGEGGSLDFIFGGKTINVPYHEFVWAQPESNTCVLGAFEDDFPVLGDTFLRSAYVVYDWDNRNIYLAQSDDCGSNLVAIGSGPDAVPSIVGECGKPKPTSTSTFSKTSSKTSTASKTSSTSDSTSSSSSHVTTSSSSTTATTLSTHKPPFPTASGNFTTTRSPTTTTASSTISKSTLTITSATTYTITSCPPTVTRCPAHEVTTEIITKTTAVCPETTATYTIPRTITCPGSGGGDDCPPGATRTTTLTVTLSPVGPTDRTTHVVPGVTTTTPTTITAPPTGQTTTTLVPALPPTTTTMSGHRGINGTVTATSKPPAVTAGSAKVGLVSGATAIVAGVMAVLMAL

SEQ ID NO: 82 - protein, 551 aa, Neurospora crassa
MLPVPLTTLSLYVVALLSPPAAAGVLASATTKLPIKLPISPAQGHRSSTAASPSLTSRSSSSGNGFIRASVHAAHGAPPKLRRRQEDEGLKNQNLGTTYTIDIDIGTPPQTVTLILDTGSPDLWVNPQCETSGQEKYCNSFRQFDYTKSKTIQDTGAADILKYGKGNVTIEYVTDDVIIGSAKIKSQILGIGFESIDIPLGILGLSPSVSPDGTSPYPYLLDSMASQGIISSRAFSLDLRSIDNPSGAIIFGGVDLGKFSGSLAKLPMLDPSQTPAGVDRYWIVLSGVGMTYPDGEEVESEEIGVPVFLDSGGTLSRLPETIFQAIGDSFPGSQYDPESGFYIVDCAVAEQAGSVDFIFGSSGSRSSKKIRVPYGDFVWEVQTGVCVVGVLPTDDEPVFGDSFLRAAYVVFDQDNRNLHLAQAANCGEQIVEIGSGQDAVPSSTGKCKDGSAGSTKTAGGGGLDVTATRAPTRTAGGSGPAVTNSDFGPGPAGTRVSTGGIGLPTGTGGGGGSGDGNGNNDDDDSAASGLDVGVTAAAVLAGLNMLIVWLL

SEQ ID NO: 83 - protein, 529 aa, Neurospora crassa
MKSTLATLLALASVAVAENGVVNFPLNRGVPHFRVGNVRQNVKRDTYSQALINNITGGAYYAEVTVGTPGQKVSVVLDTGSSDLWVVSYKADLCTDPSIQRQWGDSCDKTYNPTKSSSYKVLEEDSFEIRYLDNSTAAGDYITDDLNIGGATIKSLQMGYATKTVRGAGILGVGYSSNVASQQRYPNLIDQFVAQKLITTKAYSLYLNDRRSDTGSILFGGIDKDKFIGDLSILPIYLAKGQAEPIHFEVEMQSVSLALTKNGKTTKIISTDPSLSQTSTIAILDSGTTLSYLPSKITDQIHTKLSVYVDEIWTGLTFIDCQYLTSNPDLRLSFTFGANATISVPVWELVLDLLGESQSELPFKMPFKNACIFGIQSTAGFQEDNFDEDWALLGETFLRSAYVVYDLTHHQIGIAQANLNSTTTDIVELSGADGGLPTGLTGVKEQQTSNDPSGNAGSGSGSSTDKDGAKETETVTAGSTAATGTAASGAKETDSAAAGLSARGGAVGALAVASLTGFLALVGGAVVAL

SEQ ID NO: 84 - protein, 566 aa, Myceliophthora thermophila
MKPSSAILLALAPGSSSKNVVEFSVSRGLPGNRTPLSFPPLTRRETYSERLINNIAGGGYYVQVQVGTPPQNLTMLLDTGSSDAWVLSHEADLCISPALQDFYGMPCTDTYDPSKSSSKKMVEEGGFKITYLDGGTASGDYITDHFTIGGVTVQSLQMACVTKAVRGTGILGLGFSISERASTKYPNIIDEMYSQGLIKSKAFSLYLNDRRADSGTLLFGGIDTDKFIGPLGVLPLHKPPGDRDYSSFEVNFTSVSLTYTNGSRHTIPTAILNHPAPAVLDSGTTLSYLPDELADPINTALDTFYDDRLQMTLIDCSHPLLRTDPDFHLAFTFTPTTSITVPLGDLVLDILPPTYPQSNSNNNNEVEDDDDDDDDDDDDDKVPPATERRWCVFGIQSTTRFAASSGQSEANFTLLGDTFLRSAYVVYDLSHYQIGLAQANLNSSSSSTNTNTIVELTADNHDDGASERGEGAGAGADAGTRTVIAGGLPSGLMGVEAQQTTFTPTATANGHPGYGGGPGGSTRPGSERNAAAGGFTAVRTGLLGELVGVAAVTALFILLGGALIAV

SEQ ID NO: 85 - protein, 897 aa, Myceliophthora thermophila
MVRLDWAAVLLAATAVAKAVTPHTPSFVPGAYIVEYEEDQDSHAFVNKLGGKASLRKDLRFKLFKGASIQFKDTETADQMVAKVAEMPKVKAVYPVRRYPVPNHVVHSTGNVADEVLVKRQAAGNDTFSTHLMTQVNKFRDAGITGKGIKIAVIDTGIDYLHEALGGCFGPDCLVSYGTDLVGDDFNGSNTPKPDPDPIDNCQGHGTHVAGIIAAQTNNPFGIIGAATDVTLGAYRVFGCNGDTPNDVLIAAYNMAYEAGSDIITASIGGPSGWSEDPWAAVVTRIVENGVPCVVSAGNDGDAGIFYASTAANGKKVTAIASVDNIVTPALLSNASYTLNGTDDFFGFTAGDPGSWDDVNLPLWAVSFDTTDPANGCNPYPDSTPDLSGYIVLIRRGTCTFVEKASYAAAKGAKYVMFYNNVQQGTVTVSAAEAKGIEGVAMVTAQQGEAWVRALEAGSEVVLHMKDPLKAGKFLTTTPNTATGGFMSDYTSWGPTWEVEVKPQFGTPGGSILSTYPRALGSYAVLSGTSMACPLAAAIYALLINTRGTKDPKTLENLISSTARPNLFRLNGESLPLLAPVPQQGGGIVQAWDAAQATTLLSVSSLSFNDTDHFKPVQTFTITNTGKKAVTYSLSNVGAATAYTFADAKSIEPAPFPNELTADFASLTFVPKRLTIPAGKRQTVTVIAKPSEGVDAKRLPVYSGYIAINGSDSSALSLPYLGVVGSLHSAVVLDSNGARISLASDDTNKPLPANTSFVLPPAGFPNDTSYANSTDLPKLVVDLAMGSALLRADVVPLSGGAATATARLTRTVFGTRTIGQPYGLPARYNPRGTFEYAWDGRLDDGSYAPAGRYRFAVKALRIFGDAKRAREYDAAETVEFNIEYLPGPSAKFRRRLF

SEQ ID NO: 86 - protein, 876 aa, Neurospora crassa
MVRLGLATTLLAAASFAQAAHQKAPAVVPGAYIVEYEDSHDPTSILASIKGDATIRKDIRHELFKGASFQFKDLNKADDLASKVAAMSGVKALYPVRRYSIPEHTVHSTGSAVQEVVAKRDTGNDTFSPHLMTQVNKFRDSGITGKGIKIAVIDTGVDYLHPALGGCFGPGCLVSYGTDLVGDDFNGSNTPVPDSDPMDTCNGHGSHVLGLLSANTNNPYGIIGAAPDVTLGAYRVFGCSGDVGNDILIEAYLKAYDDGSDIITASIGGASGWPEDSWAAVVSRIVEKGVPCLVSAGNDGATGIFYASTAANGKRVTAVASVDNILAPALLSEASYSVANGSLSTFGFTAGSPSAWANVSLPVWSVNFNTADAANGCEAFPDDTPDLSKYIVLIRRGTCTFVQKAQNAAAKGAKYIIYYNNASGSTKVDVSAVADVKAAAMVTSETGAAWIKALQAGTQVTVNMADPETAPKNLNNFPNTATPGFLSTYTSWGPTYEVDVKPQISSPGGMILSTYPRALGSYAVLSGTSMACPLAAATWALVMQKRGTKDPKVLENLFSATAHPNLFNDGTKTYPMLAPVAQQGAGLIQAWDAANANALLSVSSISFNDTEHFKPLQSFEVTNTGKKAVTYQLGHTSAATAYTFANDTSIGPAAFPNELVDAKATLVLTPAKLTLNPGQKKTVTVLAIPPLGLDAKRLPVYSGYITLNGTDSTGYSLPYQGVVGSMRSVTVLDKQNSYLSQSSDATYAPVAAGTTFTLPPAGKANDTLYATTVYPTIVLTLSMGSAEVHADVVNSKGKTIGQVLTFPARWNPRGTFEWNWDGALSDGTYAPADTYKITLKALKIYGNSKWPLDWETQTTEPFTIKYAAKSKRAFTA

SEQ ID NO: 87 - protein, 534 aa, Myceliophthora thermophila
MRGLVAFSLAACVSAAPSFKTETINGEHAPILSSSNAEVVPNSYIIKFKKHVDESSASAHHAWIQDIHTSREKVRQDLKKRGQVPLLDDVFHGLKHTYKIGQEFLGYSGHFDDETIEQVRRHPDVEYIERDSIVHTMRVTEETCDGELEKAAPWGLARISHRDTLGFSTFNKYLYAAEGGEGVDAYVIDTGTNIEHVDFEGRAKWGKTIPAGDADVDGNGHGTHCSGTIAGKKYGVAKKANVYAVKVLRSNGSGTMADVVAGVEWAAKSHLEQVQAAKDGKRKGFKGSVANMSLGGGKTRALDDTVNAAVSVGIHFAVAAGNDNADACNYSPAAAEKAVTVGASAIDDSRAYFSNYGKCTDIFAPGLSILSTWIGSKYATNTISGTSMASPHIAGLLAYYLSLQPATDSEYSVAPITPEKMKSNLLKIATQDALTDIPDETPNLLAWNGGGCNNYTAIVEAGGYKAKKKTTTDKVDIGASVSELEKLIEHDFEVISGKVVKGVSSFADKAEKFSEKIHELVDEELKEFLEDIAA

SEQ ID NO: 88 - protein, 396 aa, Neurospora crassa
MKLSAVLALLPLAMAAPSAPIDKRAPILEARAGTQAVPGKYIVKLRETASDDDLDKAVKKLGNSKADHVYKHAFRGFAGRIDDKTLDDIRSLPEVEYVEQEAVFTINTYTSQSSVPSWGLARLSSKTTGKTTYVYDSSAGAGTCAYIIDTGINTAHSDFGGRATWLANYAGDGINSDGNGHGTHVAGTVGGTTYGVAKKTQLYAVKVLDSNGSGSNSGVIAGMNFVAQDAQSRNCPNGTVANMSLGGGYSASTNSAAAAMVRAGVFLAVAAGNDGANAANYSPASEPTVCTVGATTSADAIAYYSNYGTIVDIFAPGTSITSAWIGSTTAKNTISGTSMATPHITGLGAYLLTLLGKKSPAALCSYIASTANSGVISGIPRGTVNKLAFNGNPSAY

SEQ ID NO: 89 - protein, 392 aa, Myceliophthora thermophila
MHFSTALLAFLPAALAAPTAETLDKRAPILTARAGQVVPGKYIIKLRDGASDDVLEAAIGKLRSKADHVYRGKFRGFAGKLEDDVLDAIRLLPEVEYVEEEAIFTINAYTSQSNAPWGLARLSSKTAGSTTYTYDTSAGEGTCAYVIDTGIYTSHSDFGGRATFAANFVDSSNTDGNGHGTHVAGTIGGTTYGVAKKTKLYAVKVLGSDGSGTTSGVIAGINFVADDAPKRSCPKGVVANMSLGGSYSASINNAAAALVRSGVFLAVAAGNENQNAANSSPASEASACTVGATDRNDAKASYSNYGSVVDIQAPGSNILSTWIGSTSATNTISGTSMASPHIAGLGAYLLALEGSKTPAELCNYIKSTGNAAITGVPSGTTNRIAFNGNPSA

SEQ ID NO: 90 - protein, 433 aa, Neurospora crassa
MVRFSVAAAFLLSALGVTAAPSGGRHNHQNTQNTGATAGNAAGVPVANSDISNIIPGRYIVVYNNTFGEEAINAHQIKVTSLVAKRNLGKRDAKTGRIMSPSVKAFKMGTWRAMALDADDDMINDINSAQEVEYIEADQYVKLNALTSQNSTTTGLARLSHAGPSKKAAPYIFDSSAGEGITAFVVDTGIRVTHSEYEGRATFAANFVNNVDTDENGHGSHVAGTIAGATFGVAKKAKLVAVKVLDGSGSGSNSGVLQGMQFVADTATSQKLGGKAVLNMSLGGGKSRAINSAINQIAAAGVVPVVAAGNENQDTANTSPGSAPAAITVGAIDQRTDARASFSNFGAGVDIFAPGVNVLSVGIKSDTDTDTLSGTSMASPHVAGLAAYLMALEGLTDVTAVGNRIKELAQKTGAKVTNNVRGTTSLIANNGNL

SEQ ID NO: 91 - protein, 420 aa, Myceliophthora thermophila
MAGRLLLCLTAALSALGVSAAPAPDASGRPFIGVPVSNPGIANAIPNRYIVVYNNTFNDEDIDLHQSNVIKTIAKRNIAKRSLTGKLLSTTVNTYKINNWRAMALEADDATINEIFAAKEVSYIEQDAVISLNVRQMQSQATTGLARISHAQPGARTYIFDSSAGEGITAYVVDTGIRVTHEEFEGRATFAANFIDDVDTDEQGHGSHVAGTIGGKTFGVAKKVNLVAVKVLGADGSGSNSGVIAGMQFVASNATAMGLKGRAVMNMSLGGPASRAVNSAINQVEAAGVVPVVAAGNESQDTANTSPGSAEAAITVGAIDQTNDRMASFSNFGELVDIFAPGVNVQSVGIRSDTSTNTLSGTSMASPHVAGLAAYIMSLENITGVQAVSDRLKELAQATGARARGVPRGTTTLIANNGFA

SEQ ID NO: 92 - protein, 421 aa, Neurospora crassa
MVGLKNVALFAASIILPASITWAAPIIEVETKPIPEKYIVLLKPHADLEGHLSWAKDVHARSLSRRDTAGVHKAWSVGSKFKAYAGEFDEETLKIIQRDERNVHSIEPDKSWRLYKSNKKDNDDSNSDNTTIITQKQAPWGLGYLSHKGKTSSDYVYNSTAGTGTYAYVVDTGCWKDHVEFEGRVQLGYNAYPDSPFIDMDGHGTHVTGTLISKTYGVAKNATVICVKVFHGGGSANTIVMDGFEWAVKDIIAKKRQRNSVINMSLGCDRSEAFNAIVDAAYDQGILTVVAAGNENQPAALVSPASSARAFSVGAIDNKNTRAYFSNYGAIVDIFAPGVNIVSTYIGKKDGDNNRTMTMSGTSMASPHVAGLALYLKSLDPEKYGNSSDAHSGLRALGVPDKVWDAGEMSPNLVAYNGVQG

SEQ ID NO: 93 - protein, 243 aa, Myceliophthora thermophila
MKLAVLIATTAGLAAALPQGVARRGVGRPLHHSGPNIRNTTYPQYSSNWAGAVQIGTGFTSVYGTITVPSVHDRNPNAAASAWVGIDGDTCQQAILQTGVSFYGDGSFDAWYEWIPDYAYSFSNFRLSAGDQIRMSVEASSKRAGVATLENLSTGQKVSHTFTSTPSTLCETNAEWIVEDFQEGSSLVPFADFGTVTFTDAYATGSSGTVTPSGATIIDIKQGNEVLTNCATSGSDLTCSYTG

SEQ ID NO: 94 - protein, 288 aa, Neurospora crassa
MKLLSPAISLLGVISQPILAQFTFTSTVEHNGVPVPQAETDLKPFKPGTLGRIRSRTDDDSGPEIGTTTLRRVKRTNPTANSNNWCGSVQSTTSSNQIKLVHGTFQHPTCTQRPGVTQYPQAAAAWIGIDGDSWTSALLQAGTVCKINNSTGIVENEVWWQWVPNGAYTITNIPVFAGDWFDITINTTSSTAATIKIMSNRGYTYSVNAWQGATLARVDADWVVERPYYGSTLAGFAQFTQVWFQNAYATLTSGTSSLGITGAKQYQIPGGCASAEYDNSKLYAAVAA

SEQ ID NO: 95 - protein, 285 aa, Myceliophthora thermophila
MWSIVRSLSLASLISSACTVTAQLSFVASVKQHGKDVDASGLSFVRIPPLEHRWHASRPRRGQNNRTVERDAVSYSANWCGASQHASDSDGIKSVLGYFTAPDLTLRPGTPAPQFAAAWVGIDGAACNTTLLQAGVTTIVNSDGGQSASAWWEWYPEASYTISGLKVKAGEWMSVNITTKDASSAILVIENADTGTSVTLELNNGPQLCRRDAEWILEDFYESGKQVALANFADLWFVDSGATTVGGKNVGFDGATMVHLRDENGNVLCSPEPYDNSNFVVVSKP

SEQ ID NO: 96 - protein, 307 aa, Myceliophthora thermophila
MKPTVLFTLLASGAYAAATPAIPGYSPRTRGMNPHHHAPLRLLHTFTPISTSGKSFRLLASSTESTKGGAILGLPDNDLSTVRTTIRIPAAKMPTAGPTANNTVGEYAASFWVGIDSATDACGAGGSLRAGVDIFWDGTLGGQQTPFAWYQGPGQADVVGFGGGFPVGEGDLVRLTLEAGPAGGEEIAVVAENFGRNVTRADEGAVPVRKVRKVLPAEAGGQKLCRGEAAWMVEDFPLQGRPEFPTALANFTSVTFNTGITLDDGTEKDLTGAEVLDIQLEAQGGRLTSCEVVDDRNVKCARVVGDN

SEQ ID NO: 97 - protein, 197 aa, Myceliophthora thermophila
MRWPLAALLGSALVARQALAELTFTVEATRNGVPIPASEIRLEPFEPGRTRMGAVAEAPRAQRKTRRSNAQADSANWCGSVNMAPTGTNIQLAHGSFQHPSCSIRPGYTFPQAAASWVGIDGDSYRDALLQAGTVCKIDNSTGVVRHEAWWQWVPSAAFTITSMPGQSNTTGFCIPYSAPFVSLCFFGRTRTCLFLH

SEQ ID NO: 98 - protein, 621 aa, Myceliophthora thermophila
MLRNIFLTAALAAFGQCGSTVFESVPAKPRGWTRLGDASADQPLRLRIALQQPNEDLFERTLYEVSDPSHARYGQHLSRDELSALLAPRAESTAAVLNWLRDAGIPSDKIEEDGEWINLRVTVREASELLDADFGVWAYEGTNVKRVRALQYSVPEEIAPHIRMVAPVVRFGQIRPERSQVFEVVETAPSQVKVAAAIPPQDLDVKACNTSITPECLRALYKVGSYQAEPSKKSLFGVAGYLEQWAKYDQLELFASTYAPYAADANFTSVGVNGGENNQGPSDQGDIEANLDIQYAVALSYKTPITYYITGGRGPLVPDLDQPDPNDVSNEPYLEFFSYLLKLPDSELPQTLTTSYGEDEQSVPRPYAEKVCQMIGQLGARGVSVIFSSGDTGVGSACQTNDGKNTTRFLPIFPGACPYVTSIGATRYVEPEQAAAFSSGGFSDIFKRPAYQEAAVSTYLHKHLGSRWKGLYNPQGRGFPDVSAQGVAYHVFSQDKDIKVSGTSASAPLFAALVSLLNNARLAQGRPPLGFLNPWLYSEKVQKAGALTDIVHGGSSGCTGKDMYSGLPTPYVPYASWNATPGWDPVTGLGTPVFDKLLELSSPGKKLPHIGGGHGHGAGGH

SEQ ID NO: 99 - protein, 587 aa, Neurospora crassa
MLWSVLLLAAGASAHVKSSLPSVPSGWKKVRAASADESVSLKIALPAHQPDALETAILRVSDPNHHEYGMHLSSEEVRSLVAPADETTDAVTSWLNRNGIKGKVDNDWVSFTTSVAKANNLLNTTFDWYQQDGDKTGPKLRTLQYSVPDELDAHVDMIQPTTRFGKLAAKASTIFEIFDEPEPKNIANVKVGGDHPTCTGCIYPDEIRSLYNIKYKPSASDKNTIAFASYLEQYSNYDDFTSFAKAFIPDAADRNYTVKLVKGGLHDQSPDKIGVEANLDLQYILAISNPIPIREYSIGGRGPLVPTANQPGPEISNEPYLDFFQYLLSLKNSELPATLSTSYGEEEQSVPREYALKVCSMIGQLGARGVSVIFSSGDSGPGDACIRNDGTNSTYFEPTFPGACPWVTSVGGTYQTGPEKAVDFSSGGFSMYHKRPVYQERVVKKYLDKIGDTYSDFFDEQGRGFPDVSAQASRYAVYVDGRLVGVSGTSASAPMFAGLVALLNAARKSHGLPSLGFINPLLYASKDAFTDIVNGAGTGCRGRPEFAGDVGGTAKWNATEGWDPVTGLGTPKFDKLLALAAPGVKNA

SEQ ID NO: 100 - protein, 720 aa, Myceliophthora thermophila
MRIRHALVGIASLCCLLGTASGARISSRDMLSRRVVPPSHTLHERHEAGNVEGWVKRGLADAESTVPVRIGLKQSNVDAAHDLLMDISDPRSPNYGKHLSRSEVEDLFAPREHSVAKVKRWLASAGVDEGRISQSANKQWIQFDAPVYELEKLLLTRYHIFENLETGVQNIACSEYHVPRDVSHHIDYITPGIKLMAGGREERMVRWRKADRRSLVAGLASQGRKGAHGMGHGGGGGSRSPDDPVVDDSPFRVTGPCSAEITPNCIRAQYQLPNGTRAASGNELGIFQGLGQHYSQEDLDNYWKYVAPWVPRGTHPELRSINGALGPANDTLRAGEEADLDFQIAIPLIWPQRTVLFQTDDEWYQQDQQRADTKYPGFFNTFFDAIDGSYCHMTAFNMTGNCVTPECRDPEYPNPNATPEQGGYAGALMCGRHRPTSVVSVSYSGTEDSWPASYMRRQCLEVLKLALQGVTVVESSGDFGVGGRPFDPRAGCLGPDRAVFSPRVMANCPYVLSVGATALVDPEQEQQQQHADRGGSGKEPRLVEVAARTFASGGGFSNIFGRPKWQDRHVREYLRKTNLSELGYDNAAGMSFDSLRPPPAGGKLFNRLGRGYPDVAAVGQNFRVVLRGYPNRMHGTSAAAPVWASILTLINEERRAVGKGPVGFVHQVLYQHPEVFTDITVGSNPGCGTDGFPVEEGWDPVTGLGSPIYPKLLKLFMSLP

SEQ ID NO: 101 - protein, 719 aa, Neurospora crassa
MFRFHLWTLLRLFALLSSLVTASRIVLEEAGHLPAGWKVERHATASDRIQLSIALKEPGIEELKRRLLQQSTSDDHPNSRQFTKEEVEKHRQPDQRSVTAVGRWLQSHGIKSYNADNSWITFKATAATVQMLFEADLAYYSYNGDPSTQILRSRSYTIPRWLSDDIDFVHPLTNFMPPRNRNDGTLGIGRRQPIQPKLSAREDFFAPPCWTGTFPGCIRKLYNLTYTPSPDFRSPSPVRFGIASFLEQYITHRDVTSFLATYARELLPLRPTPSRGGSGGSLTLPPVTNTTSEPPYNITITLLNNATRWDPHSTDPALSGLEANLDVQYALSLGHPTRVIYYATGGRGTKLDSSGRPLPTNDPRANNEPFLEFLQALLALPDNQIPHVLSISYADDEQSVPRKYAHRVCDLFAAVAARGTSVLVATGDGGAAGIGFSAGGGDTCIKNDGSGRRAFVPTFPASCPWVTSVGATDNTALNLTGAAFSSGGFSEYFDRPLWQRAAVDPYVSSLLRSRSSKPGQPSQPRDLKGVYFSHNGRGMPDMAAIGSGFQIIHRGEMVEVRGTSASTPVVAAMVALVNDQRLRQGKRSLGWLNGHLYLDPRVRRVLTDVKWGRSEGCVFPGEALEEGRGKGKEKYWRHSVVEKRQGNSEEDGGTHGGDGEGKADEEDWGGEGEVGEGEGDQSENVILGGWDARKGWDPVTGLGVPGDFQEMLKVLGSVW

SEQ ID NO: 102 - protein, 454 aa, Neurospora crassa
MRATLVVVLCHLSLAFALAISPAASHWKRSARLASDQTASERYSLPSRVARYIDYVLPAPDPDPVSSAPKSVAVQDPPTLKGVIGARQTRDVDCLQYIAPQCLRQLAWLAEDLDMFFGDFAPDLLTNFNLEPNLDYKYTMAMAKPIPVTNIQVGDFVVQGNMNIMLAAFNAHYCRTGLDPQFDPVYPNPAPGGYNASDCGTHVPPRVIAIMYAWNKAWYSDADFASIFPASDPWVTSVGGTQFLPVVSNGSSSTTASSGMPSSSSSSSSSSSSSSSSSSSSLFPGETALDDNNTGSSGGSFSRLFPGPWYQGNLTREYLASAPGAAELARQGYFNGSGRGYPDISAMARSFLVALHGGYHAVSGTSASTPVVAAMVAKINDARLHAGKSTVGFLNPVLYSAAAGKAGVLRDVPLGKNHDCGVGEAFPARRAWDAVTGLGTPDFEKLKELYLGLP

SEQ ID NO: 103 - protein, 857 aa, Leishmania major
MGKRKGNSLGDSGSAATASREASAQAEDAASQTKTASPPAKVILLPKTLTDEKDFIGIFPFPFWPVHFVLTVVALFVLAASCFQAFTVRMISVQIYGYLIHEFDPWFNYRAAEYMSTHGWSAFFSWFDYMSWYPLGRPVGSTTYPGLQLTAVAIHRALAAAGMPMSLNNVCVLMPAWFGAIATATLAFCTYEASGSTVAAAAAALSFSIIPAHLMRSMAGEFDNECIAVAAMLLTFYCWVRSLRTRSSWPIGVLTGVAYGYMAAAWGGYIFVLNMVAMHAGISSMVDWARNTYNPSLLRAYTLFYVVGTAIAVCVPPVGMSPFKSLEQLGALLVLVFLCGLQVCEVLRARAGVEVRSRANFKIRVRVFSVMAGVAALAISVLAPTGYFGPLSVRVRALFVEHTRTGNPLVDSVAEHQPASPEAMWAFLHVCGVTWGLGSIVLAVSTFVHYSPSKVFWLLNSGAVYYFSTRMARLLLLSGPAACLSTGIFVGTILEAAVQLSFWDSDATKAKKQQKQAQRHQRGAGKGSGRDDAKNATTARAFCDVFAGSSLAWGHRMVLSIAMWALVTTTAVSFFSSEFASHSTKFAEQSSNPMIVFAAVVQNRATGKPMNLLVDDYLKAYEWLRDSTPEDARVLAWWDYGYQITGIGNRTSLADGNTWNHEHIATIGKMLTSPVVEAHSLVRHMADYVLIWAGQSGDLMKSPHMARIGNSVYHDICPDDPLCQQFGFHRNDYSRPTPMMRASLLYNLHEAGKRKGVKVNPSLFQEVYSSKYGLVRIFKVMNVSAESKKWVADPANRVCHPPGSWICPGQYPPAKEIQEMLAHRVPFDQVTNADRKNNVGSYQEEYMRRMRESENRR

SEQ ID NO: 104 - protein, 836 aa, Leishmania infantum
MGKKGNLLGDSGSAATASPPANMILLPKTPIDTKDFIGIFSFPFWPVRFVVTVVALFVVGASCFQAFTVRMTSVQIYGYLIHEFDPWFNYRAAEYMSTHGWSAFFSWFDYMSWYPLGRPVGSTTYPGLQLTAVAIHRALAAAGMPMSLNNVCVLMPAWFGAIATATLAFCTYEASGSTVAAAAAALSFSIIPAHLMRSMAGEFDNECIAVAAMLLTFYCWVRSLRTRSSWPIGVLTGVAYGYMVAAWGGYIFVLNMVAMHAGISSMVDWARNTYNPSLLRAYTLFYVVGTAIAVCVPPVGMSPFKSLEQLGALLVLVFLCGLQACEVFRARAGVEVRSRANFKIRVRVFSVMAGVAALAIAVLAPTGYFGPLSVRVRALFVEHTRTGNPLVDSVAEHQPAGPEAMWSFLHVCGVTWGLGSIVLALSTFVHYAPSKLFWLLNSGAVYYFSTRMARLLLLSGPAACLSTGIFVGTILEAAVQLSFWDSDATKARKQQKPAQRHRRGAGKDSDRDDAESATTARTLCDVFAGSPLAWGHRMVLFIAVWALVTTTAVSFFSSDFASHSTTFAEQSSNPMIVFAAVVQNRATGKPMNILVDDYLRSYIWLRDNTPEDARILAWWDYGYQITGIGNRTSLADGNTWNHEHIATIGKMLTSPVAEAHSLVRHMADYVLIWAGQSGDLMKSPHMARIGNSVYHDICPHDPLCQQFGFYRNDYSRPTPMMRASLLYNLHEVGKTKGVKVDPSLFQEVYSSKYGLVRVFKVMNVSEESKKWVADPANRVCHPPGSWICPGQYPPAKEIQEMLAHRVPFDQVEKVDRKNHVGSYHEEYMRRMRESES

SEQ ID NO: 105 - protein, 854 aa, Leishmania braziliensis
MGKKKAIPSGSVGPATTTSREAPGKDEGASQPAKTAALPVKPFVLPNTLTDEEEFVGIFPCPFWPVRFVITVMALVLLGASCIRAFTIRMLSVQLYGYIIHEFDPWFNYRAAEYMSAHGWSAFFSWFDYMSWYPLGRPVGTTTYPGLQLTAVAIHRALAAAGVPMSLNNVCVLIPAWYGAIATAILALCAYEVSRSMVAAAVAALSFSIIPAHLMRSMAGEFDNECIAVAAMLLTFYLWVRSLRTRCSWPIGILTGIAYGYMVAAWGGYIFVLNMVAMHAGISSMVDWARNTYNPSLLRAYALFYVVGTAIATRVPPVGMSPFRSLEQLGALAVLLFLCGLQACEVFRARADVEVRSRANFKIRMRAFSVMAGVGALAIAVLSPTGYFGPLTARVRALFMEHTRTGNPLVDSVAEHHPASPEAMWTFLHVCGVTWGLGSIVLLVSLLVDYSSAKLFWLMNSGAVYYFSTRMSRLLLLTGPAACLSTGCFVGTLLEAAIQFTFWSSDATKAKKQQETQLHQKGARKHSDRSNSKNALTVRTLGDVLRSTSLAWGHRMVLCFAMWALVITVAVCLLGSDFTSHATMFARQTSNPLIVFATVLRDRATGKPTQVLVDDYLRSYLWLRDNTPRNARVLSWWDYGYQITGIGNRTSLADGNTWNHEHIATIGKMLTSPVAEAHSLVRHMADYVLIWAGQGGDLMKSPHMARIGNSVYHDICPNDPLCQHFGFYKNDRNRPKPMMRASLLYNLHEAGRSAGVKVDPSLFQEVYSSKYGLVRIFKVMNVSAESKKWVADPANRVCHPPGSWICPGQYPPAKEIQEMLAHRVPFDHVNSFSRKKAGSYHEEYMRRMREEQDR

SEQ ID NO: 106 - protein, 852 aa, Leishmania mexicana
MGKNKANSVADSGSAATAPREAPAQAKDAAPQAQTASPPPKKTLLPKTLTDETEFVGIFPFPFWPVRFVVTVVALFGLGASCLQAFTVRMTSVKIYGYLIHEFDPWFNYRAAEYMSTHGWSAFFSWFDYMSWYPLGRPVGSTTYPGLQFTAVAIHRALAAAGIPMSLNDVCVLIPAWFGAIATALLALCTYEASGSTVAAAAAALSFSIIPAHLMRSMAGEFDNECIAVAAMLLTFYCWVRSLRTRSSWPIGVLTGVAYGYMVAAWGGYIFVLNMVAMHAGISSMVDWARNTYNPSLLRAYTLFYVVGTAIAVCVPPVGMSPFKSLEQLGALLVLVFLCGLQVCEVLRARAGVEVRSRANFKIRARVFSAMAGGAALAIALLAPRGYFGPLSARVRALFVEHTRTGNPLVDSVAEHQPASPEAMWSFLHVCGVTWGLGFIVLAVSTFVNYSPSKVFWVLNSGAVYYFSTRMARLLLLSGPAACLSTGIFVGAILEAAVQLSFWDSDATKAKPQKQTQRHQRGARKDNKRNDAESGMTALSLCDIVSGSSLAWGHRMVLCIAMWALVTTTVVTFISSGFASHSLKFAEQSSNPMIVFAASVPNRATGKPMMILVDDYLHSYLWLRDNTPRSARILAWWDYGYQITGIGNRTSLADGNTWNHEHIATIGKMLTSPVAEAHSLVRHMADYVLIWAGQSGDLMKSPHMARIGNSVYHDICPNDPLCQQFGFYRNDYHRPTPMMRASLLYNLHEAGKTAAVKVDPSLFQEVYSSKYGLVRIFKVMNVSAESKKWVADPANRVCRPPGSWICPGQYPPAKEIQEMLAHRVSFDQVDKDKKRKATYHEEYMRRMRENEI

SEQ ID NO: 107 - DNA, 2575 bp, Leishmania major
aatgggcaagcgcaagggcaacagcctcggcgacagcggcagcgccgccaccgcctcacgagaggcctctgcccaggccgaggacgccgccagccagaccaagaccgccagcccccctgccaaggtcatcctcctgcccaagaccctcaccgacgagaaggacttcatcggcatcttcccgttcccgttctggcccgtccacttcgtcctcaccgtcgtcgccctcttcgtcctcgccgccagctgcttccaggccttcaccgtccgcatgatcagcgtccagatctacggctacctcatccacgagttcgacccctggttcaactaccgagccgccgagtacatgagcacccacggctggtccgcctttttcagctggttcgactacatgagctggtatccgctcggccgacccgtcggcagcaccacctaccccggcctccagctcaccgccgtggccatccatcgagccctcgccgctgccggcatgcctatgagcctcaacaacgtctgcgtcctcatgcccgcctggttcggcgccattgcgaccgccaccctcgcgttctgcacctacgaggccagcggctctacagtggccgctgccgcggctgccctcagcttcagcatcatccccgcccacctcatgcgctccatggccggcgagttcgacaacgagtgcattgccgtcgccgccatgctcctcaccttctactgctgggtccgcagcctccgcacgcgcagcagctggcccatcggcgtcctgaccggcgtcgcctacggctacatggctgccgcctggggcggctacatcttcgtcctcaacatggtggccatgcacgccggcatcagcagcatggtcgactgggcccgcaacacctacaaccccagcctgctccgcgcctacaccctcttctacgtcgtcggcaccgccattgccgtctgcgtcccccccgtcggcatgagccccttcaagagcctcgagcagctcggcgccctcctcgtcctggtctttctgtgcggcctccaggtctgcgaggtcctccgagcccgagccggcgtcgaggtccgctctcgcgccaacttcaagatccgcgtccgcgtctttagcgtcatggccggcgtggccgccctcgccatctctgtcctcgcccccaccggctacttcggccccctcagcgtccgagtgcgcgccctgttcgtcgagcacacccgcaccggcaaccccctcgtcgacagcgtcgccgagcaccagcccgccagccccgaggccatgtgggcctttctccacgtctgcggcgtcacctggggcctcggcagcatcgtcctggccgtcagcaccttcgtccactacagccccagcaaggtcttttggctcctcaactctggcgccgtctactacttctcgacccgaatggcccgcctcctcctcctgtccggccctgccgcctgcctgagcaccggcatcttcgtcggcacgatcctcgaggccgccgtccagctcagcttctgggacagcgacgccaccaaggccaagaagcagcagaagcaggcccagcgccaccagcgaggcgctggcaagggctctggccgcgacgacgccaagaacgcgacgaccgcccgagccttctgcgacgtctttgccggcagcagcctcgcctggggccaccgcatggtcctctcgatcgccatgtgggcgctcgtcacgacaacggccgtcagcttcttcagcagcgagttcgccagccacagcaccaagttcgccgagcagagcagcaaccccatgatcgtctttgccgccgtcgtccagaaccgcgccaccggcaagccgatgaacctcctcgtcgacgactacctcaaggcctacgagtggctccgcgacagcacccctgaggacgcccgcgtcctggcctggtgggactacggctaccagatcaccggcatcggcaaccgcaccagcctcgccgacggcaacacctggaaccacgagcacattgccaccatcggcaagatgctcaccagcccggtcgtcgaggcccacagcctcgtccgccacatggccgactacgtcctcatctgggctggccagagcggcgacctcatgaagtccccccacatggcccgcatcggcaacagcgtctaccacgacatctgccccgacgaccccctctgccagcagttcggcttccaccgcaacgactacagccgccccaccccgatgatgcgcgccagcctcctctacaacctccacgaggccggcaagcgaaagggcgtcaaggtcaacccctcgctgttccaggaggtctacagcagcaagtacggcctggtccgcatcttcaaggtcatgaacgtcagcgccgagagcaagaagtgggtcgccgatcccgccaaccgagtctgccacccccctggcagctggatctgccctggccagtaccctcccgccaaggaaatccaggagatgctcgcccaccgcgtcccgttcgaccaggtcaccaacgccgaccgcaagaacaacgtcggcagctaccaagaggagtacatgcgccgcatgcgcgagagcgagaaccgccgctag

SEQ ID NO: 108 - DNA, 2511 bp, Leishmania infantum
atgggcaagaagggcaacctcctcggcgatagcggctctgctgccaccgccagcccccctgccaacatgatcctgctccccaagacccccatcgacaccaaggacttcatcggcatcttcagcttcccgttctggcccgtccgcttcgtcgtcaccgtcgtcgccctcttcgtcgtcggcgccagctgcttccaggccttcaccgtccgcatgaccagcgtccagatctacggctacctcatccacgagttcgacccctggttcaactaccgagccgccgagtacatgagcacccacggctggtccgcctttttcagctggttcgactatatgagctggtatcccctcggccgacccgtcggcagcaccacctaccccggcctccagctcaccgctgtcgccatccaccgagccctcgctgcggctggcatgcccatgagcctcaacaacgtctgcgtcctcatgcccgcctggttcggcgccattgcgaccgccaccctcgcgttctgcacctacgaggccagcggcagcacagtggctgctgccgctgcggccctcagcttcagcatcatccccgcccacctcatgcgcagcatggccggcgagttcgacaacgagtgcattgccgtcgccgccatgctcctcaccttctactgctgggtccgctccctccgcacccgcagcagctggcccatcggcgtcctcaccggggtcgcctacggctacatggtggccgcctggggcggctacatcttcgtcctcaacatggtcgccatgcacgccggcatcagcagcatggtcgactgggcccgcaacacctacaaccccagcctgctccgcgcctacaccctcttctacgtcgtcggcaccgccattgccgtctgcgtcccccccgtcggcatgagccccttcaagagcctcgagcagctcggagcgctgctcgtcctggtctttctgtgcggcctccaggcctgcgaggtctttcgcgcccgagccggcgtcgaggtccgcagccgcgccaacttcaagatccgcgtccgcgtgttcagcgtcatggccggcgtcgccgccttggctatcgccgtcctcgcccccaccggctacttcggccccctcagcgtccgcgtgcgcgccctgttcgtcgagcacacccgcaccggcaatcccctggtcgacagcgtcgccgagcaccagcctgccggccctgaggccatgtggtcgttcctccacgtctgcggcgtcacctggggcctcggatccatcgtcctggccctcagcaccttcgtccactacgcccccagcaagctgttctggctcctcaactctggcgccgtctactacttctcgacccgaatggcccgcctcctgctcctcagcggccctgccgcctgcctcagcaccggcatcttcgtgggcaccatcctcgaggccgccgtccagctcagcttctgggacagcgacgccaccaaggcccgcaagcagcagaagcctgcccagcgccaccgacggggagccggcaaggatagcgaccgcgacgacgccgagtctgccaccaccgcccgcaccctctgcgacgtctttgccggcagccccctcgcctggggccaccgcatggtcctcttcattgccgtgtgggccctcgtcacgacgaccgccgtcagcttcttcagcagcgacttcgccagccacagcaccaccttcgccgagcagagcagcaaccccatgatcgtctttgccgccgtcgtccagaaccgcgccaccggcaagccgatgaacatcctcgtcgacgactacctccgcagctacatctggctccgcgacaacacccccgaggacgcccgcatcctcgcctggtgggactacggctaccagatcaccggcatcggcaaccgcaccagcctcgccgacggcaacacctggaaccacgagcacattgccaccatcggcaagatgctcaccagccccgtcgccgaggcccacagcctcgtccgccacatggccgactacgtcctcatctgggctggccagagcggcgacctcatgaagtccccccacatggcccgcatcggcaacagcgtctaccacgacatctgcccccacgaccccctctgccagcagttcggcttctaccgcaacgactacagccgccccaccccgatgatgcgcgccagcctcctctacaacctccacgaggtcggcaagaccaagggcgtcaaggtcgaccccagcctcttccaagaggtctacagcagcaagtacggcctcgtgcgcgtgttcaaggtcatgaacgtcagcgaagagtccaagaagtgggtcgcggaccccgccaacagggtctgccacccccctggcagctggatctgccctggccagtaccctcccgccaaagagatccaagagatgctcgcccaccgcgtcccgttcgaccaggtcgagaaggtcgaccgcaagaaccacgtcggctcctaccacgaagagtacatgcgccgcatgcgcgagagcgagagctga

SEQ ID NO: 109 - DNA, 2559 bp, Leishmania mexicana
atggggaaaaataaggcaaattcagtggccgactccggctctgcggcaaccgcacctcgtgaagctcctgcccaagccaaagatgccgccccacaagcccagaccgcatctccaccgcctaagaagactttgttgcccaaaacgctaacagatgagacggaatttgtcggcatctttccgttccctttctggccagtacggttcgtcgttacggtggtggcactcttcggcttaggcgccagctgcctccaagccttcacggttcgcatgacctcggttaagatttacggatacctgatccacgagttcgacccgtggttcaactaccgcgctgccgagtacatgtccacgcacggctggtccgccttcttcagctggttcgactacatgagctggtacccgctgggccgccccgtcggctccaccacgtacccgggcctgcagttcactgccgtcgccattcaccgcgcactggcggctgccggcatcccgatgtctctcaacgacgtgtgtgtgctgatcccggcgtggtttggcgccatcgctaccgctcttctggctctttgcacgtacgaagccagtgggtcgacggtggcggccgccgctgccgccctctccttctccatcatcccagcccacctgatgcggtccatggcgggtgagttcgacaacgagtgcatcgccgtcgccgccatgctgctcaccttctactgctgggtgcgctcgctgcgcacgcggtcctcgtggcccatcggcgtcctcaccggtgtcgcctacggctacatggtggcggcgtggggcggctacattttcgtgctcaacatggttgccatgcatgccggcatatcatcgatggtggactgggcccgcaacacgtacaacccgtcgctgctgcgtgcatacacgctgttctacgttgtcggcaccgccatcgccgtgtgcgtgccgccagtggggatgtcgcccttcaagtcgctggagcagctgggtgcgctgctggtgcttgtcttcctgtgcgggctgcaggtgtgcgaggtgctgcgggcacgcgccggtgtcgaggttcgctctcgcgcgaacttcaagatccgcgcgcgcgtcttcagcgcgatggctggcggggctgcgcttgcaatcgcgctgctggcaccgagggggtacttcgggcccctttcggctcgtgtgcgtgcgctgttcgtggagcacacgcgcactggcaatccgctggtcgactcggtcgccgaacatcaacccgccagccctgaggcaatgtggtcgtttcttcacgtgtgcggcgtgacatggggcttgggcttcattgtgcttgctgtctcaacgttcgtgaactactccccgtcgaaggtcttctgggtactgaactctggtgccgtgtactacttcagcacccgcatggctcggctgctgcttctctccggtcccgctgcgtgtctgtccactggcattttcgtgggggcaattctggaagcagcggtgcagctcagcttttgggacagtgatgcgacaaaggccaagccccagaagcagacccaacgccaccagaggggggctcgtaaggacaacaagcgaaatgacgctgagagcggaatgaccgcgctctcactttgcgacatcgtgtccggtagctctctggcttggggccatcgtatggtgctgtgcatcgctatgtgggctctcgtgacgacaaccgtggtgaccttcatcagttccggtttcgcgtcccactcactaaaatttgcggagcagtcgtcaaatccgatgattgttttcgcggcctccgtgccaaaccgtgcaacaggcaagcctatgatgatattggtggatgactacctgcacagctatctctggctgcgcgataacacacccaggagtgcgcgcattttggcctggtgggactacggctaccagatcacaggcatcggcaaccgcacctcgctggccgatggcaacacctggaaccacgagcacatcgccaccatcggcaagatgttgacgtcgcccgtggcggaggcgcactcgctggtgcgccacatggccgactacgtcctcatctgggctgggcagagcggagacttgatgaagtcaccgcacatggcgcgcatcggcaacagtgtgtaccacgacatctgccccaacgacccgctgtgccagcaattcggcttttacagaaatgattaccatcgtccaacaccgatgatgcgggcgtcgctgctgtacaacctgcacgaggccgggaaaacagcggccgtgaaggtggacccatccctctttcaggaggtgtactcgtccaagtacggcctggtgcgcatcttcaaggtcatgaacgtgagcgcggagagcaagaagtgggttgctgacccggcaaaccgcgtgtgccgcccgcctgggtcgtggatctgccccgggcagtacccgccggcgaaggagatccaggagatgctggcacaccgggtctccttcgatcaggtggacaaggacaagaagcgcaaggcgacgtaccacgaggagtacatgcgccggatgcgtgaaaacgagatctga

SEQ ID NO: 110 - DNA, 2565 bp, Leishmania braziliensis
atgggtaagaagaaagcaattccgtcgggcagcgtcggccctgcgacaaccacctcccgtgaagctccaggcaaagacgaaggtgcctcccaacccgccaagactgcagctctgccggtgaagccctttgtgttgcccaacacgctgacagacgaggaggagtttgttggcatctttccctgccctttctggccagtgcgatttgtcatcacagtgatggcactcgtcctcttgggtgccagctgtatccgcgccttcacgattcgcatgctatccgttcagctttatggctacatcatccacgagttcgacccgtggttcaactaccgcgccgccgagtacatgtccgcgcacggctggtccgccttcttcagctggttcgactacatgagctggtacccgctgggccgccccgttggcaccaccacgtacccgggcctgcagctcaccgccgttgccatccaccgcgcattggcggctgccggggtgccgatgtctctcaacaacgtgtgcgtgctgatccccgcgtggtatggtgccatcgctactgctatcctggccctttgcgcttacgaggtcagtaggtcaatggtagcggcggctgttgctgcactctcattctccatcattccagcacacctgatgcggtccatggcgggcgagttcgacaacgagtgcatcgccgttgcagccatgctcctcaccttctacttgtgggtacgctcgctgcgcacgcggtgctcgtggcccatcggcatcctcaccggtatcgcctacggctacatggtggcggcgtggggcggatacatttttgtgctcaacatggttgccatgcacgccggcatatcatcgatggtcgactgggctcgcaacacgtacaacccgtcgctgctgcgcgcatacgcgctgttctacgttgtcggcaccgccatcgccacgcgcgtgccgcctgtggggatgtcgcccttcaggtcgctggagcagctgggtgcgctggcggtgctcctcttcctgtgcgggctgcaggcctgcgaggtgtttcgcgcacgggccgacgtcgaggttcgctcccgcgcgaacttcaagatccgcatgcgtgccttcagcgtgatggctggcgtgggtgcgcttgcaatcgcggtgctgtcgccgaccgggtactttggccccctcacggctcgtgtgcgtgcgctgttcatggagcacacgcgcactggcaatccgctggtcgactcggtcgctgagcaccaccccgccagtcctgaggcgatgtggacatttcttcacgtgtgcggcgtgacttggggtttgggctccattgttcttcttgtgtcgttgctggtggactactcctcggcaaagctcttttggctgatgaactctggtgccgtgtactatttcagcacccgcatgtcacgactgctgcttctcacgggccccgctgcgtgtctgtccactggctgtttcgtggggacattactggaagcggcgatacagttcaccttctggtccagcgatgcaacaaaggccaaaaaacagcaagagacacaacttcaccaaaagggcgcgcgcaagcatagcgaccggagtaactctaagaatgcactgactgtgcgtacattgggcgacgtcttgaggagtacctctctggcatggggtcatcgcatggtgctctgcttcgctatgtgggctcttgttattacagtcgcggtgtgcctcttgggttccgatttcacttcccatgcaacgatgtttgcaaggcagacgtcgaacccgctgattgtctttgcaaccgtgctgcgagaccgcgctaccggcaagccaacacaggtattggtggatgactacctgcgcagctatctctggctgcgcgacaacacgcccagaaatgcgcgcgtgctgtcctggtgggactacggctaccagatcacaggtatcggcaaccgcacctcgctggccgatggcaacacctggaaccacgagcacatcgccaccatcggcaagatgctgacgtcgcccgtggcggaggcgcactcactggtgcgccacatggcggactacgtcctcatctgggctgggcagggcggagacttgatgaagtcgccgcacatggcgcgcattggcaacagcgtgtaccacgacatctgccccaacgacccgctttgccagcatttcggcttttacaagaacgatcgcaatcgcccaaaaccgatgatgcgcgcgtcgctgctgtacaacctgcacgaggccggacgaagcgcgggtgtgaaggtggacccgtccctctttcaggaagtgtactcatccaagtacggcctggtgcgcatcttcaaggtcatgaacgtgagcgcggagagcaagaagtgggtggctgacccggcaaaccgcgtgtgccacccgcctgggtcgtggatctgccccgggcagtacccgccggcgaaggagatccaggagatgctggcgcaccgcgtcccctttgaccatgtgaacagcttcagtcggaaaaaggccgggtcttatcatgaagaatacatgcgccggatgcgtgaagagcaggaccgatga

SEQ ID NO: 111 - protein, 514 aa, Trichoderma virens
MRFISSSVFALGLVAPALAYPRPEVVKRGSPNPTRAAAVKAAFQTSWNAYRQFAFPHDDLHPVSNGFDDERNGWGSSAIDGLDTAILMGASDIVNTILQRVPQINFTTTAVANQGISVFETNIRYIGGLLSSYDLLKGPFSSLVTNQTLVNNLLSQAQTLANGLKVAFNTTSGVPDPTVYFNPTYRRSGASSNNIAEIGTLVLEWTRLSDLTGNPLYAQLAQKGESYLLNPTGSPEAWPGLVGTFVSTSSGAFQDSNGSWSALSDSFYEYLIKMYLYDPVAFANYKDRWVLAADSTIAHLASHPTTRKDLTFLSAYSGQSTSPNSGHLASFAGGNFILGGILLGQQKYIDFGIQLTNSYYATYNQTASGIGPEGFAWVDSVTGAGGSPPSSQSSFYSKAGFWVSAGYYILRPETLESLYYAYRVTGDSKYQDWAWAAFSAITKVCRAGSAYSSINDVTQANGGGASDDMESFWFAEALKYAYLIFAEESDVQLNPNGGNKFVFNTEAHPFSIRK

SEQ ID NO: 112 - protein, 514 aa, Trichoderma atroviride; identical to SEQ ID NO: 111

SEQ ID NO: 113 - protein, 523 aa, Trichoderma reesei
MRFPSSSVLALGLIGPALAYPKPGATKRGSPNPTRAAAVKAAFQTSWNAYHHFAFPHDDLHPVSNSFDDERNGWGSSAIDGLDTAILMGDADIVNTILQYVPQINFTTTAVANQGISVFETNIRYLGGLLSAYDLLRGPFSSLATNQTLVNSLLRQAQTLANGLKVAFTTPSGVPDPTVFFNPTVRRSGASSNNVAEIGSLVLEWTRLSDLTGNPQYAQLAQKGESYLLNPKGSPEAWPGLIGTFVSTSNGTFQDSSGSWSGLMDSFYEYLIKMYLYDPVAFAHYKDRWVLAADSTIAHLASHPSTRKDLTFLSSYNGQSTSPNSGHLASFAGGNFILGGILLNEQKYIDFGIKLASSYFATYNQTASGIGPEGFAWVDSVTGAGGSPPSSQSGFYSSAGFWVTAPYYILRPETLESLYYAYRVTGDSKWQDLAWEAFSAIEDACRAGSAYSSINDVTQANGGGASDDMESFWFAEALKYAYLIFAEESDVQVQANGGNKFVFNTEAHPFSIRSSSRRGGHLA

SEQ ID NO: 114 - protein, 527 aa, Trichoderma reesei
MRFPSSSVLALGLIGPALAYPKPGATKRGSPNPTRAAAVKAAFQTSWNAYHHFAFPHDDLHPVSNSFDDERNGWGSSAIDGLDTAILMGDADIVNTILQYVPQINFTTTAVANQGISVFETNIRYLGGLLSAYDLLRGPFSSLATNQTLVNSLLRQAQTLANGLKVAFTTPSGVPDPTVFFNPTVRRSGASSNNVAEIGSLVLEWTRLSDLTGNPQYAQLAQKGESYLLNPKGSPEAWPGLIGTFVSTSNGTFQDSSGSWSGLMDSFYEYLIKMYLYDPVAFAHYKDRWVLAADSTIAHLASHPSTRKDLTFLSSYNGQSTSPNSGHLASFAGGNFILGGILLNEQKYIDFGIKLASSYFATYNQTASGIGPEGFAWVDSVTGAGGSPPSSQSGFYSSAGFWVTAPYYILRPETLESLYYAYRVTGDSKWQDLAWEAFSAIEDACRAGSAYSSINDVTQANGGGASDDMESFWFAEALKYAYLIFAEESDVQVQANGGNKFVFNTEAHPFSIRSSSRRGGHLAKDEL

SEQ ID NO: 115 - protein, 773 aa, Trichoderma reesei
MARSPTPQGSLRQRNVASKQAPVESAFVPEVELDKLSKAALSSRRNIQRGELEHKLALTLVTILGFVTRFWGISHPDEVVFDEVHFGKFASYYLQRTYFFDVHPPFAKLLFAFVGWLVGYDGHFHFDNIGDSYVANKVPYVAFRALPAFLGALTVSVTYLIMWESGYSVPACLVATGLILLDNAHIGQTRLILLDATLVLAMACSLLFYIKFYKLRHEPFSRKWWKWLILTGFALSCDISTKYVGLFAFVTIGSAVIIDLWDLLDIKRRYGAISMPEFGKHFAARAFGLIILPFLFYLFWFQVHFSVLTRSGPGDDFMTPEFQETLSDNVMLASAVDIQYYDTITIRHKETKAYLHSHTDTYPLRYDDGRISSQGQQVTGYPHNDTNNYWQILPADNDQKLGRNVKNQDLVRLRHIVTDKILLSHDVASPYYPTNQEFTCVTPEEAFGERQNDTLFEIRIEGGKTGQDFKTVASHFKLIHFPSKVAMWTHTTPLPEWAYRQQEINGNKQITPSSNVWIAEDIPSLPEDDARRHKEQRKVKSLPFLRKWFELQRSMFYHNNKLTSSHPYSSQPYHWPFLLRGVSFWTQNDTRQQIYFVGNPIGWWLASSLLAVFAGIIGADQVSLRRGIDALDHRTRSRLYNSTGFFFLAWATHYFPFFLMGRQLFLHHYLPAHLASCLVTGSLVEFIFNTDPADEEPSRSKNPKATGPRRHITARERFAGKSMAGAWIACFVILAAAAASWYFFLPLTYGYPGLSVEEVLRRKWLGYDLHFAK

SEQ ID NO: 116 - protein, 944 aa, Trichoderma reesei
MAKATARGRSPQPPLVAEKMPVAVTAPVASSKSKAAKKNSSYRSDGVADNDVFLLPGADYVAALGVTVLATIVRLFKIYTPTSVVFDEVHFGGFASKYIKGRFFMDVHPPLAKMLIALTGWLAGFDGNFDFKDIGKDYLEPGVPYVAMRMFPAVCGILLAPFMFFTLKAVGCRTTTAILGASFIIFENGLLTQARLILLDSPLVAATAFTAMSFNCFTNQHEQGPDKAFSLSWWFWLAMTGLGLGITSSIKWVGLFTIAWVGSLTLVQLWVLLGDSKNVSMRLWFKHFMARVFCLIIIPLTFYLSMFAIHFLCLTNPGEGDGFMSSEFQATLNSKGMKDVPADVVFGSRVTIRHVNTQGGYLHSHPLMYPTGSLQQQITLYPHKDENNIWIMENQTQPLGVDGQPINGTEAWDALPEVHHVVDGSVIRLYHKPTFRRLHSHDVRPPVTEAEWQNEVSAYGYEGFEGDANDLFRVEIVKKQSKGPLAKERLRTIETKFRLIHVMTGCALFSHKVKLPEWASEQQEVTCARGGSLPNSIWYIEYNEHPLLGDDVEKVNYANPGFFGKFWELHKVMWKTNAGLTDSHAWDSRPPSWPILRRGINFWGKHHMQVYLLGNPFIWWSSTAAVAIWVIFKGVAILRWQRGCNDYASSTFKRFDYEIGTSVLGWALHYFPFYLMERQLFLHHYFPALYFAILALCQMFDFATVRIPAALGYRSTLINRVGTVSLLVISAAVFTLFAPLAYGTPWTKAECNRVKLFDKWDFDCNTFLDDYKSYTLTSLAPSSIAPSPPAANVPVVNQEQKPLAKQPEPVISQAAVPQEPQILSKEEKIEYRDQDGNLLNDEQVKALQGKVEFKTKYETKTRVVDAQGHEIPVPEGGWPDDMIAGVAPPHPDVEGVDKETPKVESAEVPKEAAASRDGEVEAENLKAKPASEGQEVEATVQEEL

SEQ ID NO: 117 - protein, 740 aa, Trichoderma reesei
MAADKAALASGADLGDGLRKRQAASQAVPSFIPAQTEDTKKLAKKDKTFVQVLADWESVLAPLIFTAVAIFTRLYKIGLSNIVTWDEAHFGKFGSYYIKHEYYFDVHPPLGKMLVGLSGVLAGYNGSFEFKSGEQYPEDVNYTFMRAFNAAFGIACIPMAYFTAKELKLTRPAVWFVTLMVLCENSYTTISRFILLDSMLLCGTFATTLCWAKFHNQRHNSFEPEWFFWLFMTGLSIGCVCSVKLVGLFVTALVGLYTIEDLWRKYGDRKMPIPVLAAHFSARVVGLIIVPFLIYMLSFALHFAILDHSGPGDAQMSSLFQANLKGTEVGKNSPLEIALGSRATIKNMGYGGGLLHSHVQTYPEGSGQQQVTCYHHKDANNDWFFYPNRHEPDYDPEGELRFIGDGSVIRLIHAQTGRNLHSHDIDAPITKSHREVSSYGNLTVGDEKDHWKIEVVRDAASRDRSRIRTLTTAFRLKHTVLGCYLRAGNVNLPQWGFKQIEVTCDKQNNPRDTYTHWNVEAHWNDRLPPSDPGVYKSPFIHDFIHLNVAMMTSNNALVPDPDKQDDLASQWWQWPILHVGLRMCSWDDNIVKYFLLGNPFVYWASTASLGAVALVIAWYVVRWQRGFKELSNSEVDQIHYAGIYPVIGWFLHYLPFVIMARVTYVHHYYPALYFAILSLGFLVDWVLRNRAAVVQGVAYGILYTVVIGLYILFMPICWGMTGSSKQYSYLKWFDNWRISD

SEQ ID NO: 118 - DNA, 2322 bp, Trichoderma reesei
atggctcgaagtccaacgccgcagggcagcctgcgacagcggaacgttgcgtccaagcaggcgcctgtcgagtcggcattcgttcccgaggtcgagctcgacaagctctccaaggccgctctgtcgtcgcgccgaaacatccagagaggcgagctcgagcacaagcttgccctgacgctggtgacgatcctcggctttgtcacgcgattctggggcatcagccaccccgacgaggtcgtctttgacgaggtgcattttggaaagttcgcctcctactacctccagcgaacctacttcttcgacgtccacccccctttcgccaagctgctcttcgccttcgttggctggctggttggctacgacggtcacttccacttcgacaacattggcgactcctacgtggccaacaaggtgccctatgtcgccttccgagccttgcccgccttcctcggcgcattgactgtgtcggtcacatacctcatcatgtgggagtctggctatagtgtgccggcttgccttgtcgcgaccggcctgatcctcctggacaatgcgcacattggccagacccgcctcattctgctcgacgccaccctggtgctcgccatggcctgcagtctcttgttctacatcaagttctacaagctgcggcacgagccctttagccgcaagtggtggaagtggctcatcctgaccggctttgcgctgtcgtgcgacatctcgaccaagtatgtcggtctctttgcctttgtcaccattggctccgccgtcatcattgatctgtgggatcttttggatatcaagcgccgctatggagccatcagcatgccagagtttggaaagcactttgcagcccgcgcctttggcctcatcatcttgcccttcctcttctacctcttctggttccaggtgcacttttccgtcctgacccgatccggtcccggcgacgacttcatgactcccgagttccaggagacgttgagcgacaacgtcatgctggcaagcgccgtcgacatccagtactacgataccatcaccatcaggcacaaggagaccaaggcgtatcttcacagccacaccgacacctaccctctgcgatatgacgacggccgcatctccagccaaggccaacaggtcaccggctacccccacaacgacaccaacaactactggcagatcctccctgccgacaatgaccagaagctcggccgtaacgttaagaatcaagacttggtgcgacttcgacacattgtcacggacaagatcctgctctcccatgatgtcgcctcgccctactaccctaccaaccaggagttcacctgtgtgacccccgaggaagcattcggcgagcgccaaaacgacactctgttcgagatccggattgagggaggcaagaccggccaggacttcaagaccgttgccagccacttcaagctcattcacttccccagcaaggtggccatgtggactcataccacgccccttcccgagtgggcctacaggcagcaggaaatcaacggcaacaagcaaatcactcccagctccaacgtctggattgccgaagacattccttcgctcccggaagacgacgctcgccgccacaaggagcagcgcaaggtcaagtcgctgccgttcctccgcaagtggtttgagctgcagaggtccatgttctaccacaacaacaagctgaccagcagccacccctactccagccagccctaccactggccattcctcctccgcggagtgagcttctggacgcagaatgacacacgccagcaaatctactttgtgggcaaccccatcggctggtggcttgccagcagtctgctggctgtgtttgccggcatcattggagctgatcaggtctcgctgcgccgaggcatcgatgctctggatcaccgcacccgctcccgactgtacaactctaccggcttcttcttccttgcctgggccacccactacttcccctttttcctcatgggtcgtcagctgttcttgcatcactacttgcctgcccatttggcgtcctgcctggtcacgggctccctcgtcgagttcatctttaacacggacccggcagacgaggagccttcgcgatccaaaaaccccaaggctactggtcctcggagacacatcacggctcgcgagcggtttgctggcaagagcatggccggtgcctggatcgcttgctttgtgattctcgctgccgccgcggctagctggtacttcttcttgccgttgacgtatggctaccccggactgtctgttgaggaggttctcaggagaaagtggcttggatatgatcttcactttgccaagtag

SEQ ID NO: 119 - protein, 775 aa, Aspergillus oryzae
MSQSPSPSLRKRGGKKEASPGPSEVSSPYPTNQGATPKPQSEWDYRLAITVLTVLAFITRFYRISYPDEVVFDEVHFGKFASYYLQRTYFFDVHPPFGKLLFAAVGWLIGYDGHFLFENIGDSYIDNKVPYVAFRALPATLGALTVPVVFLIMWESGYSLPACVLAAGLVLFDNAHIGEDRLILLDATLVITMALSILCYVRFYKLRHEPFGRKWWKWLLLTGVSLSCVISTKYVGVFTFVTIGAAVMVDLWNLLDIRRPAGALSMMEWTKHFAARGFALIVVPFFFYLFWFQVHFAILTRSGPGDDFMTPEFQETLSDNALAAESIGIQYYDAITIRHKDTKVFLHSHWERYPLRYDDGRISSQGQQVTGYPFNDTNNQWQILPTVPLEDNEGQGHSVKNGDLVQLLHLGTDSILLTHDVASPFYPTNQEFTTVTKDVASGERHNETLFEIKIENGKAGQEFRTLSSHFKLIHYPTRVAMWTHTTPLPEWGFKQAEINGNKNVLQTSNLWYAESIESLEEDSPRKQKEERKVKQLPFLRKYLELQRAMFFHNNALTSSHPYASEPFQWPFLLRGVSFWTKNDTREQIYFLGNPIGWWIASSLLAVFAGVIGADQLSLRRGVDAVEEIWGPGARSRLYNSTGFLFLCWGAHYFPFWLMGRQRFLHHYLPAHLASCLVTGALIEFIFNLQPVQAVIDSEVDPSGKSKSIRPRHFVTAKERMSRKSLVACWIATLSILAVTVWGFWFYAPLTYGTPGLDVAGVNARRWLGYDLHFAK

SEQ ID NO: 120 - protein, 775 aa, Aspergillus niger
MSSSPSPSLRKRGGKKESTPVPADNFSSPLSKASAPRSEWDYWLAISILTVLAFVTRFYKISYPNEVVFDEVHFGKFASYYLQRTYFFDVHPPFGKLLFAFMGWLVGYDGHFLFDNIGDSYIEHQVPYVALRAMPATLGALTVPVVFLIMWESGYSLPACVLSAGLVLFDNAHIGEDRLILLDASLVLTMALSILCYIRFYKLRHEAFGRKWWKWLLLTGVSLSCVISTKYVGVFTFVTIGSAVMVDLWNLLDIRRRGGALTMFQWGQHFVARAFALIIVPFFFYLFWFQVHFAILTRSGPGDDFMTPEFQETLSDNVLSAQSIGIEYYDTITMKHKDTKVYLHSHLERYPLRYDDGRISSQGQQVTGYPYNDTNNQWQIIPTVPLDVTDTSGHKVRNGDVVQLRHMGTDTILLTHDVASPYYPTNQEFTTVSHEVANGDRHNDTLFEIKIENGKPHQEFRTLSSHFKLIHMPTRVAMWTHTTPLPDWAFKQAEINGNKNILQTSNLWFVESIESLEEDSPRLVKEERQVKHLPFFRKYLELQRAMFFHNNALTSSHPYASEPFQWPFLLRGVSFWTKNDTREQIYFLGNPVGWWIASSLLAVFAGVIGADQLSLRRGVDAVEEIWGQGSRSRLYNSMGFLFLCWAAHYFPFWLMGRQRFLHHYLPAHLASALVAGALIEFIFNLEPLSVIQRVRSEDDPSGKAKASASVGRFVTAKERMGTKSLLAGWIATLVILAGTIYGFVFYAPLTYGTPGLDVPGILARKWLGYDLHFAK

SEQ ID NO: 121 - protein, 773 aa, Aspergillus nidulans
MSSSPSLRKRGGKREDTPVPSDRSFAPSASQLGAASRSSEWDYRLAITILTVLAFITRFYKISYPDQVVFDEVHFGKFASYYLRRTYFFDVHPPFAKLLLAFTGWLVGYDGHFLFENIGDSYIDNKVPYVALRAMPAVLGALTIPVVFLIMWESGYSLPACVLASGLVLFDNAHVGEDRLILLDSTLVITMALSILCYIRFYKLRHEPFGRKWWKWLLLTGVSLSCVISTKYVGVFTFVTIGSAVMVDLWNLLDIRRQGGALTMFEWTKHFAARFFSLIVVPFFFYLFWFQVHFAILTHSGPGDDFMTPAFQETLSDNAMAAQSVSIEYFDTITMRHKDTKVFLHSHSDTYPLRYDDGRISSQGQQVTGYPYNDTNNHWQIIPTVPLDETDEKSRKVRNGDIVQLRHVATDTILLTHDVASPYYPTNQEFTTVSHELADGKRHNDTLFEIRVEHGKSKQEFRTLSSQFKLVHVPTKVAMWTHTTPLPDWAYKQAEINGNKNVLQSSNIWYVEAIESLEEDSPRLKKEERKVKHLPFWRKYIELQRAMFFHNNALTSSHPYASEPFQWPFLLRGVSFWTKSDTREQIYFLGNPVGWWISSSLLAVFAGVIGADQLSLRRGVDAVEEIWGPGSRSRLYNSTGFLFLCWAAHYFPFWLMGRQRFLHHYLPAHVASALVTGALIEFIFNIQPISVPATIPVAADDPTGKGKTRRFVTARERMGVKSIVAGWIASLTILAATIWGFWFFAPLTYGTPGLDVAQVNARKWLGYDLHFAK

SEQ ID NO: 122 - protein, 774 aa, Trichoderma virens
MARTPTPQPPSLRQRNVASKQPVSEATFAPEVELDKLSKAAASSRQNIQRGETEHRVALTLVTILGFVTRFWGISHPDEVVFDEVHFGKFASYYLQRTYFFDVHPPFAKLLFAFVGWLVGYDGHFHFENIGDSYIANKVPYVAFRALPAFLGALTVSVTYLIMWESGYSVPACLVATGLILLDNAHIGQTRLILLDATLVLAMACSLLFYIKFYKLRHEPFSRKWWKWLVLTGFALSCDISTKYVGLFAFVTIGSAVIIDLWELLDIRRPGGAISLPLFGKHFAARAVGLIILPFLFYLFWFQVHFAVLTRSGPGDDFMSPEFQETLSDNVMLASAVDIQYYDTITIRHKETKAYLHSHLDTYPLRYDDGRISSQGQQVTGYPHNDTNNYWQIIPASNDQKLGRIVRNQELVRLRHIVTDKILLSHDVASPYYPTNQEFTAVSAEEAYGDRLNDTLFEIRIEGGKPNQDFKTIASHFKLIHFPSKVAMWTHTTPLPEWAYRQQEINGNKQITPSSNVWIAEDIPSLPEDHSRRQKEERKVKSLPFLRKWFELQRSMFYHNNKLTSSHPYSSQPYHWPFLLRGVSFWTQNDTRQQIYFVGNPIGWWLASGLLAVFAGIIGADQVSLRRGIDALDHRTRSRLYNSTGFFWLAWATHYFPFFLMGRQLFLHHYLPAHLASCLVTGSLVEFIFNTDPADEEPSRATNPRASGPKRHITARERFAGKSMAGAWIACFVILTVAAASWYFFLPLTYGYPGLSVDEVNRRKWLGYDLHFAK

SEQ ID NO: 123 - protein, 771 aa, Trichoderma atroviride
MARASTPQGSLRQRGVASKQTLSESTFAPEVELDKLSKAAASSRQNVQRGEIEHKIALTLVTILGFVTRFWGISHPDEVVFDEVHFGKFASYYLQRTYFFDVHPPFAKLLFAFVGWLVGYDGHFHFENIGDSYVANKVPYVAFRALPAVLGALTVSVTYLIMWESGYSLPACLVATGLILLDNAHIGQTRLILLDATLVLAMACSLLFYIKFYKLRHEAFSRKWWKWLILTGFALSCDISTKYVGLFAFVTIGSAVIIDLWDLLDIKRRNGAISLQLFGKHFAARAIGLIVLPFLFYLFWFQVHFAVLTRSGPGDDFMTPEFQETLSDNVMLANAVDIHYYDYITIRHKETKAYLHSHPDTYPLRYDDGRISSQGQQITGYPHNDTNNYWQVLPSDNVHNTERIVRNFDLVRLRHIVTDKILLSHDVASPYFPTNQEFTAVTSEEAFGERQNDTLFEIRVETAKVGAEFKTVASHFKLVHFPSKVAMWTHTTPLPEWGYKQQEINGNKQVTVSSNMWIAEDIPSLPQDDARRQKEQRQVKSLPFLRKWFELQRSMFYHNNKLTSSHPYSSQPYHWPFLLRGVSFWTQNDTRQQIYFVGNPIGWWITSSLLAVFAGIIAADQISLRRNIDALDHRTRSRLYNSTGFFWLAWATHYFPFYLMGRQLFLHHYLPAHLASCLVTGALVEFIFNSDAVEEESSKSGNRSSPKRHVTARERFAGKSMLGAWIACGVILSAAAACWYFFLPLTYGYPGLSVEEVVRRKWLGYDLHFAK

SEQ ID NO: 124 - protein, 770 aa, Fusarium oxysporum
MARSSTPQGSLRQRGAPSKKPFEEDSFDPNIELDKLAKAGAQRAAAQSETEYKIGLFLITILSFVTRFWGISHPNEVVFDEVHFGKFASYYLERTYFFDVHPPFGKLLFAFVGWLVGYDGNFHFENIGDSYIANKVPYVAYRALPATLGALTVSVTYLIMWESGYSLPACILAAGLVLLDNAHIGQTRLILLDATLVLAMACSLLFYIKWYKLRHEPFSRKWWKWLILTGFALSCDISVKYVGVFAFVTIGSAVVIDLWDLLNINRPGGAISLQEFTKHFAARAFGLIIMPFLFYLFWFQVHFAVLYRSGPGDDFMTPEFQETLSDNVMLANSIDIQYYDQITIRHKETKTYLHSHEDRYPLRYDDGRVSSQGQQITGYPYNDTNNYWEILPANNDKQIGRIVKNHELVRLRHVGTDKILLSHDVASPYYPTNQEFTAVTPEEAFGKREKDTLFEVRIEHGKKNQNFKTVAGHFKLIHNPSKVAMWTHTKPLPEWGYKQQEINGNKQIAPSSNVWIAEDIPSLPADHPRRQKPERKVKSLPFLQKWFELQRAMFYHNSKLTSSHPYASHPYQWPFLLRGVSFWTQSETRQQIYFLGNPIGWWLASSLLAVYAGILLADQVSLRRGVDALDRRTRSRLYNSTGFFFLAWATHYFPFFLMGRQLFLHHYLPAHLASCLVAGALLEFIFNSEAPEEVTIKDKKGPVSPRHHVTARERFAGQSMLGAWIACGVILSLIIAGWYFFLPLTYGYPGLSVDAILRRKWLGYDLHFAK

SEQ ID NO: 125 - protein, 788 aa, Gibberella zeae
MARSSSPSQGSLRQRGAPSKKPSEESFNPNPELDKLAKAGAQRAAAQSETEHKIGLAVITILSFVTRFWGISHPNEVVFDEVHFGKFASYYLERTYFFDVHPPFGKLLFAFVGWLVGYDGHFHFDNIGDSYIANKIPYVAFRALPATLGALTVAVTYLIMWESGYSLPACVLAAGLLLLDNAHIGQTRLILLDATLVLAMACSLLFYIKWYKLRHEPFSRKWWKWLILTGFALSCDISVKYVGVFAFVTIGCAVVIDLWDLLNINRPGGAISMQEFGKHFAARAFGLIVLPFLFYLFWFQVHFAVLYRSGPGDDFMTPEFQETLSDNVMLANAIDIQYYDSITIRHKETKTYLHSHEDRYPLRYDDGRVSSQGQQITGYPYNDTNNYWEIWPADNNKTPGRIVKNHDLVRLRHVGTDKILLSHDVASPYYPTNQEFTAVTPEEALGKREKETLFEVRLEHGKKNQNFKSVAGHFKLIHNPSKVAMWTHTKPLPEWGYKQQEINGNKQIAPSSNVWIAEDIASLEADHPRRQKPERKVKSLPFLQKWFELQRAMFYHNSKLTSSHPYASHPYQWPFLLRGVSFWTQSETRQQIYFLGNPVGWWLASSLLAVYAGILLADQVSLRRGIDALDRRKLMLQSQLMNPTLTNSKGTRSRLYNSTGFFFLAWATHYFPFFLMGRQLFLHHYLPAHLASCLVAGALLEFIFNSEPAEEITIKDKKGPVSPRHHVTARERFSGQSMASAWIACGVVLALVVAGWYFFLPLTYGYPGLSVEAILRRKWLGYDLHFAK

SEQ ID NO: 126 - protein, 775 aa, Myceliophthora thermophila
MASTSTPQGTLRQRNVGVSTKKPKDGASSDVELDKLVKAAAEKSSKNSERDFKVVFVVMTALAFLTRFWGISHPNEVVFDEVHFGKFASYYLERTYFFDVHPPLGKLLFAFMGWLVGYDGHFHFENIGDSYIVNKVPYVAFRSLPAILGALTVSVTYLIMWESGYSLPACIIAAGLILLDNAHIGQTRLILLDATLVFAMACSLLCYIKFYKLRHEPFSRKWWKWLILTGFALSCDISTKYVGLFAFITIGSAVVIDLWDLLDIKRPGGALTLAEFGKHFAARAFGLIIMPFLFYLFWFQVHFSILTRSGPGDDFMTPEFQETLSDNIMLANAVTIDYYDTILIKHKETKVYLHSHPDRYPLRYDDGRVSSQGQQVTGYPFNDTNNYWQILPGGADDQKLGRHVRNHDLVRLRHLGTDTILLSHDVASPYYPTNQEFTTVSIADAYGERAADTLFEIRIEHGKDGQEFKSVSSHFKLIHNPSKVAMWTHPKPLPDWGYKQQEINGNKQIAPSSNVWLVEDIVSLPPDHKRREKPERKVKTLPFLRKWFELQRSMFWHNNQLTASHPYASLPYQWPFLLRGVSFWTQNETRQQIYFLGNPVGWWIASSVLAIYAGIVLADQFSLRRGIDALDHRSRSRLYNSTGFFFLAWATHYFPFYVMGRQLFLHHYLPAHLASALVTGAIVEFIFAQDSLEHEVAYQAAKAGKKTGVQKRHLSARERFAGQSMVASWIATVVILIAVAASWYFFLPLTYGYPGLSVDQVLRRKWLGYDLHFAK

SEQ ID NO: 127 - protein, 774 aa, Neurospora crassa
MASTTATPEATLRQRNVPASSKKAKNGVSSDVETDKVPDAVAPAKSGSELEYKLALILITGLAFLTRFWGISHPDEVVFDEVHFGKFASYYLERTYFFDVHPPFGKLLFAFMGWLVGYDGHFHFENIGDSYIRNKVPYVAFRSLPAILGALTVSVVYMIMWESGYSLPACLIAAGLVLLDNAHIGQTRLILLDATLVFAMACSLLCYIKFHKLRHEPFSRKWWKWLILTGFALSCDISTKYVGLFAFITIGSAVCIDLWDLLDIKRPGGALTLPQFGKHFAARAFGLIIMPFIFYLFWFQVHFSILTRSGPGDDFMTPEFQETLSDNIMLANAVTIDYYDTISIRHKETKAYLHSHPDKYPLRYDDGRVSSQGQQVTGYPFNDTNNYWQILPPGPDDQKLGHPIKNHDLVRLRHIVTDTILLSHDVASPYYPTNQEFTTVSIGDAYGDRAADTLFEIRIEHGKANQEFKSISSHFKLIHNPSKVAMWTHSKPLPEWGHKQQEINGNKQLAQSSNVWLVEDIVSLPADHARREKPEKKVKTLPFLRKWFELQRSMFWHNNQLTSSHPYASLPYQWPFLLRGVSFWTQNDTRQQIYFLGNPIGWWLASSVLAIYAGIILADQFSLRRGLDAMDRRTRSRLYNSTGFFFLAWATHYFPFFVMGRQLFLHHYLPAHLASALVTGSVVEFLFSTDSAEPEYQPSKSGKKVAPTTKRRLSARERLAGQSMAGAWIATAVIMVLVAFGWYFFLPLTYGYPGLTAPEVNRRKWLGYDLHFAK

SEQ ID NO: 128 - protein, 776 aa, Penicillium chrysogenum
MSSPSPSLRKRGGKKDVYTALPSDDTSTPVSVPVKQKSEWDYWLAIVILTLLAFATRFYRLDYPNEVVFDEVHFGKFASYYLQRTYFFDVHPPFGKLLFALMGWLVGFDGSFLFENIGDSYIENNVPYLSLRAMPATLGALTIPVVFLIMWESGYSLPACVLSAGLMVFDNAHVGEDRLILLDATLVLSMALSILCYVRFYKLRHQPFGRKWWKWLLLTGFCMSCVISTKYVGFFTFVTIGAAVLIDLWNLLDINREQGALSMISWGKHFIARAVGLVIIPFMFYLFWFQVHFAILNRSGPGDDFMTPEFQETLSDNQMTAQSVGIQYFDTITMRHKDTKVFLHSHWDKYPLRYDDGRISSQGQQVTGYPHNDTNNQWQILPAEPLADSSEPKSVRNGDIIQLRHIGTESYLLTHDVASPFFPTNQEFTTVSQELADGERHNDTLFELKIESGKTAQEFRTLASLFKLVHVPTRVALWTHTTPLPEWGYKQAEINGNKNILQSSNMWYVENIENLAEDSPRLVKEERKVKTLPFLRKYFELQGAMFHHNNALTSSHPYATEPFQWPFLLRGVSFWTKNDTREQIYFLGNPIGWWIASSILAVFAGVVGADQLSLRRGVDALEEIWGPGTRSRLYNSTGFLFLCWAAHYFPFWLMGRQRFLHHYLPSHLASTMVCGALIEFIFNLQPLDPRTALPPVDDPSGKSKARSLSSLRRFITAKERMGCRSLIAGWIATLIILAATIWGFIFYAPLTYGTPGLDVAGVNARKWLNYDLHFAK

SEQ ID NO: 129 - protein, 373 aa, Trichoderma reesei
MLNPRRALIAAAFILTVFFLISRSHNSESASTSEPKDAEAEALSAANAQQRAAPPPPPQKPMIDMSGMSTYDKLAYAYEYDIESKFPAYIWQTWRKTPSEGDFEFREQEASWSIEHPGFIHEVITDSVADTLLQLLYGSIPEVLEAYHALPLPVLKADLFRYLILYARGGIYSDIDTYAIRSALEWIPPQIPKETVGLVIGIEADPDRPDWADWYSRRIQFCQWTIQSKPGHPVLRDIISRITNQTLEMKKSGKLSAFQGNRVVDLTGPAVWTDTIMDYFNDERYFDMENSKGRIDYRNFTGMETSKRVGDVVVLPITSFSPGVGQMGAKDYDDPMAFVKHDFEGTWKPESERHIGEIVQELGEGQGEAPKEQ

SEQ ID NO: 130 - protein, 344 aa, Trichoderma reesei
MAVPVKELQLRAEPTDLPRLIVYFQTTHDSSNRPISMLPLITEKGIALTHLIVCSFHINQGGVVHLNDFPPDDPHFYTLWNETITMKQAGVKVMGMVGGAAPGSFNTQTLDSPDSATFEHYYGQLRDAIVNFQLEGMDLDVEQPMSQQGIDRLIARLRADFGPDFLITLAPVASALEDSSNLSGFSYTALQQTQGNDIDWYNTQFYSGFGSMADTSDYDRIVANGFAPAKVVAGQLTTPEGAGWIPTSSLNNTIVSLVSEYGQIGGVMGWEYFNSLPGGTAEPWEWAQIVTEILRPGLVPELKITEDDAARLTGAYEESVKAAAADNKSFVKRPSINYYAMVNA

SEQ ID NO: 131 - protein, 964 aa, Trichoderma reesei
MRSTMGLSWKWTALFSLLGAILCLIGPALAVKEHEFKKCHQAGFCNRNRALADLAASQSSTWVSPYKAVFESPSLEDGKIQGVILKTINAAGDTVRLPVTISFLESGVARLTIDEERRQNKDIELRHGSAARKERYNEAANWSVVGGLEPALKAEIVHQDDSQINVKYGPEGNFEAVIRLSPFRIDFRRDGVSHIELNERGLLNVEHWRPKVERPEGEENTEEDESTWWDETFNGHTDTKPRGPESVALDISFHGYEHVYGIPEHTGPLSLKETRGGEGNYAEPYRMYNADVFEYILDSPMTLYGSIPFMQAHRKDSSVGLLWLNAADTWVDITKVKGSTNPLSLTSGAPKNTQTHWISESGIIDLFVFLGPTPQDITKKYGELTGTTAMPQEFALGYHQCRWNYFSEDDVKDVDRRFDKAHIPYDVIWLDIEYTDEIKYFTWDPHSFTDPITMGKQLDSHGRKLVTIIDPHIKRVDNYPINEQLLALDLAIHDKDGKAYEGSCWPGNSNWIDCFNPKAREWWKGLYKYDQFKGTMENTFIWNDMNEPSVFEGPETTMPKDNLHWDNWEHRDVHNLNGMTYHHSTFEALKSRKKGEYRRPFVLTRAFFSGSQRFGAMWTGDNLADWGHLQTSVTMLINQGISGFPFSGADVAGFFGDPEKDLLARWYQTAAFYPFFRAHAHIDTRRREPYLLGEPYTAIVTAALRLRYSLLPAWYTAFFHANRDGSPILRPMFWTHPSAEGGLAIDDQFFLASTGLLVKPVAEKDKYSADIWIPDDEVYYEYDTYNVAKTEQGKHVTFDAPIDRIPILMRGGHIIPRRDIPRRSSSLMRFDPYTLVVSVSKDGQAEGELYVDDGDSYEYQDGQYIHRQFSLKDDVLSSVDAEGRDTRKIKPGKWLKAMQNVHIDKIIIVGAPASWDREAVQIESDGRAWAAQVVYHAADKDRAAFATVTHVKARVGDDWSIKLA

SEQ ID NO: 132 - protein, 562 aa, Trichoderma reesei
MQRPASLALLGAVCWTVAAAGSVPRGVGPEFVSYYQNKDSFTCIANPSITIPWDRVNDNTCDCPDGSDEPGTAACAFIDPLSPEQPLIGSPSGTTNATRSLPGFWCQNKGHIGAYIPFSYVNDGVCDYDVCCDGTDEHNHPTGIKCENRCGPIGKEHRRLADERKKNVARAIVKKQEMIKEAKGLLRLAEARITALEKDIKDLSAQKEELQRKYDQVQSEEQGKLVKSEGGAGGKLGVLVGLAKERVEELREALRLVTEDREVLRGKRDELEAILKQLKDGHNPDIKDEGVKAAVQAYEDYAAREASADQLEFLESDIREILKEDDETNGVNWKAFDELHDDTDILYNFDAYIPPFIRGVIHDKIRVIRKWLMDNGMIADEAKTGSESSAARAAREAVEAADQELGNKERELQQEKTDLDKDYGPSGIFRSLKGKCAEIDAGEYTYELCWLDKTMQKSKKGHAATNMGNFERIEIAMADEDERVDGKSLGSGPRMVLRYENGQTCWNGPQRKTNVWLGCAEKEEIWRVTEAEKCVYKMEVGTPAACEDEEPAAPKDSGKDEL

SEQ ID NO: 133 - protein, 568 aa, Aspergillus niger
MILPQGSLFLVSIAACSTVVAAAGDASSRPRGVGPEFAKFYKDTTTFTCISHPAIQIPFSAVNDDYCDCPDGSDEPGTSACAFLSRNFALTPGERPGSDDLELASALPGFYCKNKGHKPGYVPFQRVNDGICDYELCCDGSDEWARPGGTKCEDKCKEIGKEWRKKEEKRQKSMTAALKKKKDLLVEAGRQQKEVEDNIKRLEVEIQAQELKVNDLQAELEEVEKQEASKVVKGKTAGKVNVLAGLAKSRVEELRNALMDVRKERDDTRARVKELEEILSKFKVEYNPNFNDEGVKRAVRSWEDYAAKGTLEGAVNNAQDRDLDEIAKPDDEKAGINWEQWENEEDGCEAGLVYQLAAYLPPSLVEFIEGKVLFVRGLLEDNGILPKAAETSTSESKVVSEAREAVKSAEKELGDKQKQLKDHKSDLETDYGVGSIFRALKGVCISKDSGEYTYEHCFLDQTKQIPKKGGGSTRMGKYTGIGSVSVDVLNEAGEIVPEDRVTLQYANGQGCWNGPARSTTVILTCGEEDAILKVAEDEKCVYSMHVTSPAVCPGGDEGATAPNRKDEL

SEQ ID NO: 134 - DNA, 2897 bp, Trichoderma reesei
  misc_feature (1)..(1): n is a, c, g, or t
ntatgaggtcgacgatggggctgtcctggaagtggacggcactcttcagccttttaggtgccattctgtgcctgatcgggcctgccttggccgtcaaggaacacgagttcaaaaagtgccaccaggccggcttctgcaaccgaaaccgtgcattggccgaccttgcggcttcccagagctcgacctgggtgtctccctacaaggctgtcttcgaatctccctcgttggaagacggaaagattcagggtgttatcctcaaaacgatcaatgccgccggcgacactgtccgactgccagtcacaatctcattcctcgaatcgggtgttgctcgcctcaccattgacgaagagaggaggcaaaacaaggacattgagctgaggcacggcagcgccgcaagaaaggaacgctacaacgaggctgcgaactggtccgttgttggcggccttgagccggctttgaaagccgagattgtccaccaggacgactctcaaatcaatgtcaaatacggtcccgaaggcaactttgaggccgtcatcagactctcgccctttaggattgatttccggagagacggtgtctcgcacatcgagctcaacgaacgcggcctgctcaatgttgagcattggagaccaaaggtcgagagaccagagggagaagaaaacaccgaggaggacgaaagcacttggtgggacgaaacgtttaacggacataccgataccaagccacgtggccccgaaagtgtggccttggacatctcgttccatggatacgagcacgtctatggtattcccgagcatacgggacctctttctctcaaggagactcgaggcggcgaaggcaactatgcagaaccctatcgcatgtacaacgccgacgtcttcgagtatatccttgacagccccatgaccctctacggctccatccctttcatgcaggctcaccgaaaggattcgtccgtcggtctcttgtggctcaatgccgccgatacgtgggttgatatcaccaaggtcaagggcagtactaaccctctgagcctgacctccggtgccccaaagaacacccagacccactggatctccgagagcggtatcatcgatctctttgtcttcttgggccccacgccccaggacattacgaagaagtatggcgagctgacgggaacaaccgctatgcctcaagagtttgccctcggctaccaccagtgccgatggaattacttctccgaagacgacgtcaaggacgttgatcggaggtttgacaaggctcatatcccgtacgacgtcatctggctggatatcgaatacaccgatgagatcaagtacttcacctgggatcctcactcattcaccgaccccatcaccatgggtaaacagttggacagccacggcagaaaactggtgacaatcattgatcctcacatcaagagggttgataactatcctatcaatgagcaactcctggctcttgacctcgccattcatgacaaggacggcaaggcatacgaaggctcgtgctggccaggcaattccaactggatcgactgcttcaaccccaaggcccgtgagtggtggaagggtctgtacaaatacgatcagttcaagggaacaatggagaacacctttatctggaacgacatgaacgaaccttccgtctttgaagggccagagactaccatgcccaaggacaatctccactgggacaactgggagcaccgagatgtccacaacctgaacggaatgacgtatcatcactctacctttgaagctctgaagagccgcaagaagggcgagtaccgacgtccgtttgtgctgacccgagcgttcttctccggatcccagcgcttcggtgctatgtggaccggtgacaacctggcggactggggccacctgcagacttccgtcaccatgctcatcaaccagggtatctctggtttcccgttctcgggcgctgacgtcgcagggttctttggagaccctgagaaggacctgcttgcccgttggtaccagacggctgcattctatccattcttccgcgcccatgctcacattgacacccgtcgccgcgaaccatacctgcttggcgagccttacactgccattgttactgcagcgctgcggctgcgatactctctcttgcccgcttggtacactgccttcttccacgcgaaccgagatggtagccctatcctccgccccatgttttggacgcatccgtctgccgagggaggcttggcgattgatgaccagttcttcctggcatctactggcttgctcgttaagcccgttgcagagaaagacaagtacagcgctgacatctggattccggatgacgaggtctactacgaatacgacacgtacaacgtggcgaagaccgagcagggcaagcacgtcacatttgacgcccccattgaccgaatccctatcctgatgcgaggaggccacatcattcctcgccgcgatattccccgccgctcgagctctctcatgcgtttcgacccctatacccttgtcgtctccgtctccaaggatggccaggccgaaggagagctgtacgtggacgatggcgatagctacgagtaccaggatggtcaatacattcatcgccagttcagcctaaaggacgatgtcctttcttcagtcgatgctgaaggccgagacactcgaaagatcaagcccggcaagtggctcaaggctatgcagaatgtccacatcgacaagatcatcatcgttggcgctcctgcttcatgggaccgagaagcggtgcagatcgaatcagacggacgcgcctgggctgcccaggtggtctaccacgccgccgacaaggacagggctgcatttgcaactgtgacccatgtgaaggcccgtgttggggatgactggagcatcaagctggcttag

SEQ ID NO: 135 - protein, 1056 aa, Caenorhabditis remanei
GANSLDTDYELDKVPAVAAPVLGNREMVKDSVISANRDGSCSLRTDVVPQVDVQMLELYERTPFDNVDGGPWKQGWRISYDEKHWNQHHKLKVFVVPHSHNDPGWIHTFEEYYERQTKQIFANMLRHLEENPGMRFIWAEISYFARWYDNLVPQQKDVVKKLVRNRQLEFVTGGWVMPDEANSHWYAMLLQLTEGQTWLKTRLNVTPTSSWSIDPFGQSPSMPYILKKSGFDNLLIQRTHYIVKKNLALKQQLEFRWRQLWDSTGETELLTHMMPFYSYDIPHTCGPDPKICCQFDFKRLPNFGVSCPWRVPPQPITDENVAKKAELIVDQWRKKSVLYKTRSVLIPLGDDFRYTQSKEWEAQRVNFEKLFDHINAEPAFNVEAKFGTLQEYFDSIRAAQPLDKFPTLSGDFFTYADVNEDYWSGYYTSRPYHKRQDRILLGYLRSAEMLHAWHTWDGEGEGELAQRLQYARQQLALFQHHDGITGTADNHVVEDYAQRMSKAIEECKFVMQQAVYRLLTRPSVYQADPKFSYLSIDDARTVDGSDSFRPTIIIGDELPIKHVVVHNSLPVHRQELVEVYLGRPFATVQDSRDGSTVPAQIAPVWSWHTRPDGVSTPQASTTKYRLVFRVSVPPMGLVVYTINARNRVQDSEGVSYAKVTILSRTPFTINLRDYPELPEFGEPRETSLKVGESGPGASFNTNGLLKSLSVDSNTVPVHLEFLKYGMRFGHGKSGAYLFHPDGPATKLPLGDPVILIVKGPLEASITTGLPFTNHQAVLRGGALELRNLVDIGSRENTEIVMRLSTTIDSGELFYTDLNGMQIIKRKRMDKLPLQANYYPVPSAMFIQDENLRLTILGGQPLGGSSLKSGEMEIMQDRRLSQDDDRGLGHGVLDNLPVLHLFRLVLESRESCTKLDPGYPAAFLTASAHAELRSLLHPPEKLIFNENEWTGLVPSFGANHEPLDRDLELVAMRSLPHVKLGKDRRPTIGLVVHRTNLEDCGSEASGEGNLSIKKLLNLDDGHEVYASPLTLLRRQEPVSADDLNLCPMDTKAFIIQR

SEQ ID NO: 136 - protein, 1038 aa, Culex quinquefasciatus
EGMAHIHQVQKHHKPTPPMTDICNIRENISVAHSDLQMLDLYETWKFENLDGGVWKQGWKIEYDAEKVKALPRLEVIVIPHSHCDPGWIMTFDEYYSRQTRNILNGMAKHLGEKDEMRFIYAEISFFETWWREQSEETRKKVKGYLEAGKLEIVTGGWVMTDEANAHYHSMVTELFEGHEWIQNHLGKNAIPKSHWSIDPFGLSPSLPHLLTSANITNAVLQRVHYSVKRELALKKNLEFYWRQLFGSTGHPDLRSHIMPFYSYDIPHTCGPEPSVCCQFDFRRMPDGGKSCDWGIPPQRITDENVAERAQMIYDQYRKKSQLFKNSVIFQPLGDDFRYDIDFEWNSQYENYKKLFEYMNSKSEWNVHAQFGTLSDYFKKLDTAISESGEKLPTLSGDFFTYADRDDHYWSGYFTSRPFYKQLDRVLQHYLRSAEIAFSLANIEEEGMMESKVFEKLVTARRALSLFQHHDGVTGTAKDHVVLDYGQKMIDALNACEDVLSESLVVLLGIDSTKKMEMDEKRVNENLLPEKLVYKVGQNVVLFNTLSRNRNEPVCIRVDSVDAGIEAEPPVTKQQISPVIEYNEESKKLVAKDGVFELCFLASLGPMESVSLKLVKSTTTSKSEIRTNSKIQVDSSFKSSTVGNGDFIVQNDKVKAEFDGENGMIKKATSLVDDKPIDLNSHFVHYGARKARRKFANGNEDNPAGAYLFLPDGEARELKKEENEWIVIGGDLVRRVFATPMSDLKILQTYTLYQGLPWIDLDNEVDVRSKENFELALRFSTSISSNDEFFTDLNGLQMIKRRRQTKLPTQANFYPMSAGVYIEDDASRMTIHSAQALGVSSLASGQIEIMLDRRLSSDDNRGLQQGVRDNKRTVAHFRIVIEPMSPTSSNKKDERVGFHSHVGHLATWSLHYPVVKMMGETTPKSIASKNLENELNCDLHVVTFRTLASPTTYEANERSTAAEKKAAMVMHRVVPDCRSRLTLPDTSCLTSGIEIEPLKLISSLKSARQTSLTNLYEGQKSEQFILQPNDVSSILVSF

SEQ ID NO: 137 - DNA, 1263 bp, Trichoderma reesei
atggcgtcactcatcaaaactgccgtggacattgccaacggccgccatgcgctgtccagatatgtcatctttgggctctggcttgcggatgcggtgctgtgcgggctgattatctggaaagtgccttatacggaaatcgactgggtcgcctacatggagcaagtcacccagttcgtccacggagagcgagactaccccaagatggagggcggcacagggcccctggtgtatcccgcggcccatgtgtacatctacacagggctctactacctgacgaacaagggcaccgacatcctgctggcgcagcagctctttgccgtgctctacatggctactctggcggtcgtcatgacatgctactccaaggccaaggtcccgccgtacatcttcccgcttctcatcctctccaaaagacttcacagcgtcttcgtcctgagatgcttcaacgactgcttcgccgccttcttcctctggctctgcatcttcttcttccagaggcgagagtggaccatcggagctctcgcatacagcatcggcctgggcgtcaaaatgtcgctgctactggttctccccgccgtggtcatcgtcctctacctcggccgcggcttcaagggcgccctgcggctgctctggctcatggtgcaggtccagctcctcctcgccatacccttcatcacgacaaattggcgcggctacctcggccgtgcattcgagctctcgaggcagttcaagtttgaatggacagtcaattggcgcatgctgggcgaggatctgttcctcagccggggcttctctatcacgctactggcatttcacgccatcttcctcctcgcctttatcctcggccggtggctgaagattagggaacggaccgtactcgggatgatcccctatgtcatccgattcagatcgccctttaccgagcaggaagagcgcgccatctccaaccgcgtcgtcacgcccggctatgtcatgtccaccatcttgtcggccaacgtggtgggactgctgtttgcccggtctctgcactaccagttctatgcatatctggcgtgggcgaccccctatctcctgtggacggcctgccccaatcttttggtggtggcccccctctgggcggcgcaagaatgggcctggaacgtcttccccagcacgcctcttagctcgagcgtcgtggtgagcgtgctggccgtgacggtggccatggcgtttgcaggttcaaatccgcagccacgtgaaacatcgaagccgaagcagcactaa

SEQ ID NO: 138 - protein, 420 aa, Trichoderma reesei
MASLIKTAVDIANGRHALSRYVIFGLWLADAVLCGLIIWKVPYTEIDWVAYMEQVTQFVHGERDYPKMEGGTGPLVYPAAHVYIYTGLYYLTNKGTDILLAQQLFAVLYMATLAVVMTCYSKAKVPPYIFPLLILSKRLHSVFVLRCFNDCFAAFFLWLCIFFFQRREWTIGALAYSIGLGVKMSLLLVLPAVVIVLYLGRGFKGALRLLWLMVQVQLLLAIPFITTNWRGYLGRAFELSRQFKFEWTVNWRMLGEDLFLSRGFSITLLAFHAIFLLAFILGRWLKIRERTVLGMIPYVIRFRSPFTEQEERAISNRVVTPGYVMSTILSANVVGLLFARSLHYQFYAYLAWATPYLLWTACPNLLVVAPLWAAQEWAWNVFPSTPLSSSVVVSVLAVTVAMAFAGSNPQPRETSKPKQH

SEQ ID NO: 139 - protein, 444 aa, Phaedactylum tricornutum
MRLWKRTTSGVPPPRRRRRGGREERLAIGLLLTLAVVWGTVLVGTLVALVASPTKSVPTFPTVPTDSRPSAAFVVSDAPGAYESPLLVFTCRRDQYLRETLRDIWNYIPTDCSVGCPLVISQDGNDPAVRRVVREFTDEFATKNVPVIHWTHTSALRGSTNGYQALAIHYGWALRRVFDGQTLSGSVHGAKHGTPQRVIILEEDLHVAPDFFDYFAATAPLLDHDSSLLAVSAFHDNGFAHNVRNASRILRSDFFPGLGWMMNRRLWVDELQSKWPGGYWDDWLREPAQRQDRAILRPEISRTYHFGTEGGTSSNQFGSHLSKILLNRETVDWSKAADLEAQLRPEVYDPAYWAMVQASTLTYTIPDALEQAKKSNARLQYTTIEQFKYLAHKLKLMADEKANVPRTAYKGIVETRPHGADYFLFLTPPLAELQKEFDIPSPKR

SEQ ID NO: 140 - protein, 391 aa, Phaedactylum tricornutum
TKSVPTFPTVPTDSRPSAAFVVSDAPGAYESPLLVFTCRRDQYLRETLRDIWNYIPTDCSVGCPLVISQDGNDPAVRRVVREFTDEFATKNVPVIHWTHTSALRGSTNGYQALAIHYGWALRRVFDGQTLSGSVHGAKHGTPQRVIILEEDLHVAPDFFDYFAATAPLLDHDSSLLAVSAFHDNGFAHNVRNASRILRSDFFPGLGWMMNRRLWVDELQSKWPGGYWDDWLREPAQRQDRAILRPEISRTYHFGTEGGTSSNQFGSHLSKILLNRETVDWSKAADLEAQLRPEVYDPAYWAMVQASTLTYTIPDALEQAKKSNARLQYTTIEQFKYLAHKLKLMADEKANVPRTAYKGIVETRPHGADYFLFLTPPLAELQKEFDIPSPKR

SEQ ID NO: 141 - protein, 445 aa, Homo sapiens
MLKKQSAGLVLWGAILFVAWNALLLLFFWTRPAPGRPPSVSALDGDPASLTREVIRLAQDAEVELERQRGLLQQIGDALSSQRGRVPTAAPPAQPRVPVTPAPAVIPILVIACDRSTVRRCLDKLLHYRPSAELFPIIVSQDCGHEETAQAIASYGSAVTHIRQPDLSSIAVPPDHRKFQGYYKIARHYRWALGQVFRQFRFPAAVVVEDDLEVAPDFFEYFRATYPLLKADPSLWCVSAWNDNGKEQMVDASRPELLYRTDFFPGLGWLLLAELWAELEPKWPKAFWDDWMRRPEQRQGRACIRPEISRTMTFGRKGVSHGQFFDQHLKFIKLNQQFVHFTQLDLSYLQREAYDRDFLARVYGAPQLQVEKVRTNDRKELGEVRVQYTGRDSFKAFAKALGVMDDLKSGVPRAGYRGIVTFQFRGRRVHLAPPLTWEGYDPSWN

SEQ ID NO: 142 - protein, 447 aa, Homo sapiens
MRFRIYKRKVLILTLVVAACGFVLWSSNGRQRKNEALAPPLLDAEPARGAGGRGGDHPSVAVGIRRVSNVSAASLVPAVPQPEADNLTLRYRSLVYQLNFDQTLRNVDKAGTWAPRELVLVVQVHNRPEYLRLLLDSLRKAQGIDNVLVIFSHDFWSTEINQLIAGVNFCPVLQVFFPFSIQLYPNEFPGSDPRDCPRDLPKNAALKLGCINAEYPDSFGHYREAKFSQTKHHWWWKLHFVWERVKILRDYAGLILFLEEDHYLAPDFYHVFKKMWKLKQQECPECDVLSLGTYSASRSFYGMADKVDVKTWKSTEHNMGLALTRNAYQKLIECTDTFCTYDDYNWDWTLQYLTVSCLPKFWKVLVPQIPRIFHAGDCGMHHKKTCRPSTQSAQIESLLNNNKQYMFPETLTISEKFTVVAISPPRKNGGWGDIRDHELCKSYRRLQ

SEQ ID NO: 143 - DNA, 1728 bp, Homo sapiens
atgcgcccctggaccggcagctggcggtggatcatgctcattctgttcgcctggggtacgctccttttttacatcggcggacacctggtccgagacaacgaccaccctgatcattcctctcgcgagttgtctaagatcctggctaagctcgagaggctcaagcagcagaacgaggacctgcgccgtatggccgaaagccttcgcatccccgaggggccgattgaccaaggcccagcgatcggccgagtcagagtgctcgaggaacagctggttaaggccaaagagcagattgagaattacaagaagcagactcggaacggcctcggtaaggatcacgagatcttgcgccgtaggatcgagaacggcgcaaaagaactctggttcttcctgcagtccgagctgaagaagctcaagaaccttgagggaaacgagctgcaacgccacgccgacgagtttctcttggacctgggccaccatgaacgatcaattatgaccgatctctactatctctcgcagacagacggcgctggcgactggcgcgagaaagaggccaaggacctgaccgagcttgtccagcgccggatcacgtacctccagaaccccaaggattgcagcaaggcgaagaagctggtctgcaatattaacaagggctgcggttacggatgtcaactccaccacgtcgtgtattgcttcatgatcgcctacggcacccagcgaacgctgatcttggagtcccagaactggcgttacgcaaccggcgggtgggaaactgttttccgccctgtcagtgagacatgcacggacaggtctggcattagcaccggccactggtcgggtgaggtcaaggacaagaacgtccaggtggtggagcttccgatcgttgactccctccatcccagacccccttacctccccctggccgtcccggaagatctcgctgaccgcctggtccgagtgcacggcgacccagccgtctggtgggtcagccagtttgttaagtatctcatccgcccccaaccttggttggagaaagagattgaggaagcgactaagaagctgggattcaagcaccccgtcatcggcgtccacgtgcgccggaccgataaggttggaaccgaggccgctttccacccgatcgaagagtacatggtccacgtggaggaacattttcagctgcttgcccgtaggatgcaggtcgacaagaagcgcgtctacctcgccacggacgacccctcgctgctcaaagaggcaaagacgaagtaccctaactatgagttcatcagcgataattccatttcttggtcagccggcctccacaaccgatacaccgagaactccctgcgcggtgttatccttgacattcactttttgtcgcaggcggacttcctcgtctgtactttcagctcccaggtctgccgggtggcttacgagatcatgcaaacactgcatccagatgccagcgccaactttcactctctcgacgacatctactatttcggcggccagaacgcccacaaccagattgctatctacgcgcaccagcccagaaccgccgacgagatccccatggaaccgggcgatatcattggtgtcgcaggcaatcattgggacggatactcgaagggggtgaaccgcaagctcggccgtacgggcctgtacccttcctataaggtccgagagaagatcgagactgttaagtacccgacctaccccgaggccgagaagtaa

SEQ ID NO: 144 - protein, 575 aa, Bos taurus
MRPWTGSWRWIMLILFAWGTLLFYIGGHLVRDNDHPDHSSRELSKILAKLERLKQQNEDLRRMAESLRIPEGPIDQGPASGRIRALEEQLVKAKEQIENYKKQTRNGLGKDHEILRRRIENGAKELWFFLQSELKKLKNLEGNELQRHADEFLSDLGHHERSIMTDLYYLSQTDGAGDWREKEAKDLTELVQRRITYLQNPKDCSKAKKLVCNINKGCGYGCQLHHVVYCFMIAYGTQRTLILESHNWRYATGGWETVFRPVSETCTDRSGVSTGHWSGEIKDKNVQVVELPIVDSLHPRPPYLPLAVPEDLADRLVRVHGDPAVWWVSQFVKYLIRPQPWLEKEIEEATKKLGFKHPVIGVHVRRTDKVGTEAAFHPIEEYMVHVEEHFQLLARRMQVDKKRVYLATDDPSLLKEAKTKYPHYEFISDNSISWSAGLHNRYTENSLRGVILDIHFLSQADFLVCTFSSQVCRVAYEIMQTLHPDASANFHSLDDIYYFGGQNAHNQIAIYPHEPRTADEIPMEPGDIIGVAGNHWDGYSKGVNRKLGRTGLYPSYKVREKIETVKYPTYPEAEK

SEQ ID NO: 145 - protein, 575 aa, Canis lupus
MRPWTGSWRWIMLILFAWGTLLFYIGGHLVRDNDHPDHSSRELSKILAKLERLKQQNEDLRRMAESLRIPEGPIDQAPASGRVRALEEQLLKAKEQIENYKKQTRNGLGKDHEILRRRIENGAKELWFFLQSELKKLKNLEGNVLQRHADEFLSDLGHHERSIMTDLYYLSQTDGAGDWREKEAKDLTELVQRRITYLQNPKDCSKAKKLVCNINKGCGYGCQLHHVVYCFMIAYGTQRTLILESQNWRYATGGWETVFRPVNETCTDRSGTSTGHWSGEVKDKNVQVVELPIVDSLHPRPPYLPLAVPEDLADRLVRVHGDPAVWWVSQFVKYLIRPQPWLEKEIEEATKKLGFNIPVIGVHVRRTDKVGTEAAFHPIEEYMVHVEEHFQLLARRMQVDKRRVYLATDDPSLLKEAKTKYPTYEFISDNSISWSAGLHNRYTENSLRGVILDIHFLSQADFLVCTFSSQVCRVAYEIMQTLHPDASANFHSLDDIYYFGGQNAHNQIAIYPHQPRTADEIPMEPGDIIGVAGNHWDGYSKGVNRKLGRTGLYPSYKVREKIETVKYPTYPEAEK

SEQ ID NO: 146 - protein, 599 aa, Mus musculus
LEPEYNVSSSLSSRKIEDRVETLKMRAWTGSWRWIMLILFAWGTLLFYIGGHLVRDNDHPDHSSRELSKILAKLERLKQQNEDLRRMAESLRIPEGPIDQGTATGRVRVLEEQLVKAKEQIENYKKQARNGLGKDHEILRRRIENGAKELWFFLQSELKKLKHLEGNELQRHADEILLDLGHHERSIMTDLYYLSQTDGAGDWREKEAKDLTELVQRRITYLQNPKDCSKARKLVCNINKGCGYGCQLHHVVYCFMIAYGTQRTLILESQNWRYATGGWETVFRPVSETCTDRSGLSTGHWSGEVNDKNIQVVELPIVDSLHPRPPYLPLAVPEDLADRLLRVHGDPAVWWVSQFVKYLIRPQPWLEKEIEEATKKLGFKHPVIGVHVRRTDKVGTEAAFHPIEEYMVHVEEHFQLLARRMQVDKKRVYLATDDPTLLKEAKTKYSNYEFISDNSISWSAGLHNRYTENSLRGVILDIHFLSQADFLVCTFSSQVCRVAYEIMQTLHPDASANFHSLDDIYYFGGQNAHNQIAVYPHKPRTEEEIPMEPGDIIGVAGNHWDGYSKGINRKLGKTGLYPSYKVREKIETVKYPTYPEAEK

SEQ ID NO: 147 - protein, 575 aa, Rattus norvegicus
MRAWTGSWRWIMLILFAWGTLLFYIGGHLVRDNDHPDHSSRELSKILAKLERLKQQNEDLRRMAESLRIPEGPIDQGTATGRVRVLEEQLVKAKEQIENYKKQARNGLGKDHEILRRRIENGAKELWFFLQSELKKLKHLEGNELQRHADEILLDLGHHERSIMTDLYYLSQTDGAGDWREKEAKDLTELVQRRITYLQNPKDCSKARKLVCNINKGCGYGCQLHHVVYCFMIAYGTQRTLILESQNWRYATGGWETVFRPVSETCTDRSGLSTGHWSGEVNDKNIQVVELPIVDSLHPRPPYLPLAVPEDLADRLVRVHGDPAVWWVSQFVKYLIRPQPWLEKEIEEATKKLGFKHPVIGVHVRRTDKVGTEAAFHPIEEYMVHVEEHFQLLARRMQVDKKRVYLATDDPALLKEAKTKYSNYEFISDNSISWSAGLHNRYTENSLRGVILDIHFLSQADFLVCTFSSQVCRVAYEIMQTLHPDASANFHSLDDIYYFGGQNAHNQIAVYPHKPRTDEEIPMEPGDIIGVAGNHWDGYSKGVNRKLGKTGLYPSYKVREKIETVKYPTYPEAEK

SEQ ID NO: 148 - protein, 575 aa, Cricetulus griseus
MRAWTGSWRWIMLILFAWGTLLFYIGGHLVRDNDHPDHSSRELSKILAKLERLKQQNEDLRRMAESLRIPEGPIDQGTATGRVRVLEEQLVKAKEQIENYKKQARNDLGKDHEILRRRIENGAKELWFFLQSELKKLKKLEGNELQRHADEILLDLGHHERSIMTDLYYLSQTDGAGEWREKEAKDLTELVQRRITYLQNPKDCSKARKLVCNINKGCGYGCQLHHVVYCFMIAYGTQRTLILESQNWRYATGGWETVFRPVSETCTDRSGLSTGHWSGEVKDKNVQVVELPIVDSLHPRPPYLPLAVPEDLADRLLRVHGDPAVWWVSQFVKYLIRPQPWLEREIEETTKKLGFKHPVIGVHVRRTDKVGTEAAFHPIEEYMVHVEEHFQLLERRMKVDKKRVYLATDDPSLLKEAKTKYSNYEFISDNSISWSAGLHNRYTENSLRGVILDIHFLSQADFLVCTFSSQVCRVAYEIMQTLHPDASANFHSLDDIYYFGGQNAHNQIAVYPHQPRTKEEIPMEPGDIIGVAGNHWNGYSKGVNRKLGKTGLYPSYKVREKIETVKYPTYPEAEK

SEQ ID NO: 149 - protein, 575 aa, Gallus gallus
MRPWTGSWRWIMLILFAWGTLLFYIGGHLVRDSEHPDHSSRELSKILAKLERLKQQNEDLRRMAESLRIPDGPIDQGPAAGKVHALEEQLLKAKEQIENYKKQTGDGLGKDHEILRRRIENGAKELWFFLQSELKKLKNLEGSELQRRIDEFLSDLGHQERSIMTDLYYLSQTDGAGDWREKEAKDLTDLVQRRITYLQNPKDCSKAKKLVCNINKGCGYGCQLHHVVYCFMIAYGTQRTLILESQNWRYATGGWETVFRPVSETCTDRSGTTTGHWSGETNDKDVQVVELPIVDSLHPRPPYLPLAVPEDLADRLIRVHGDPAVWWVSQFVKYLIRPQPWLEKEIEEATRKLGFKHPVIGVHVRRTDKVGTEAAFHPIEEYMVHVEERFELLARRMHVDKKRVYLATDDPSLLQEAKSKYPNYEFISDNSISWSAGLHNRYTENSLRGVILDIHFLSQADFLVCTFSSQVCRVPYEIMQTLHPDASAYFHSLDDIYYFGGQNAHNQIAVYAHHPRTADEIPMEPGDIIGVAGNHWDGYSKGINRKLGKTGLYPSYKVKEKIETVKYPTYPEAEK

SEQ ID NO: 150 - protein, 578 aa, Xenodermus tropicalis
MRPWTGSWRWIMLILFAWGTLLFYIGGHLVRDNENPDHSSRELSKILAKLERLKQQNEDLRRMAESLRIPEGPIEQGAAAGRIRALEEQLLKAKEQIEMYKQQSSNAVSGLGKDHEILRRAIENGAKEFWYFVQSEVKKLKHLDRNELQRHVDEIIIDMGHQQRSVMTDLYYLSQTDGAGDWREREAKDLTDLVQRRITYLQNPKDCSKAKKLVCNINKGCGYGCQLHHVVYCFMIAYGTQRTLILESQSWRYATGGWETVFKPVSETCTDRSGSSTGHWSGEANDKNVQVVELPIVDSLHPRPPYLPLGVPEDLADRLIRLHGDPAVWWVSQFVKYLIRPQPWLEKEIEESTKKLGFKHPVIGVHVRRTDKVGTEAAFHPIEEYMVHVEEHFQLLARRMQIDKKRVYLATDDPTLLQEAKAKYPQYEFISDNSISWSAGLHNRYTENSLRGVILDIHFLSQADFLVCTFSSQVCRVAYEIMQTLHPDASAHFHSLDDIYYFGGQNAHNQLAIYPHQPRNAEEIPLEPGDIIGVAGNHWDGYSKGINRKLGRTGLYPSYKVKEKIETVKYPTYQEAEK

SEQ ID NO: 151 - protein, 580 aa, Danio rerio
MRPWTGSWRWIALVLLAWGTLLFYIGGHLVKDSEHAPRSSRELAKILTKLERLKQQNEDLRRMAQSLRIPEGQSDGPISSGRLRSLEEQLSRAKQKIQSFQRLSGEGPGKDHEELRRKVENGVRELWYFVRSEVKKLPLMETGAMHKHVDTLMQDLGHQQRSVMTDLYHLSQADGAGDWREKEANELSDLVQNRIMYLQNPQDCSKARKLVCNINKGCGYGCQLHHVVYCFMIAYGTQRTLILESQNWRYATGGWETVFKPVSDTCTDRTGASTGHWSGEAHDRDVQVVELPIVDSLHPRPPYLPLAVPEDLAPRLQRLHGDPSVWWVSQFVKFLVRPQAWLEKEIQETCLKLGFKHPIIGVHVRRTDKVGTEAAFHPIEEYMVHVEDHYQSLAQRMHVDKKRVYLATDDPSLLQEAKTKYPDYEFISDNSISWSAGLHNRYTENSLRGVILDIHFLSRTNYLVCTFSSQVCRVAYEIMQTLHPDASSYFYSLDDIYYFGGQNAHNQIAIYPHQPRNSDDIPLEPGDVIGVAGNHWDGYSKGINRKTGRTGLYPSYKVKEKIETVKYPTYPEADKLLKKP

SEQ ID NO: 152 - protein, 575 aa, Homo sapiens
MRPWTGSWRWIMLILFAWGTLLFYIGGHLVRDNDHPDHSSRELSKILAKLERLKQQNEDLRRMAESLRIPEGPIDQGPAIGRVRVLEEQLVKAKEQIENYKKQTRNGLGKDHEILRRRIENGAKELWFFLQSELKKLKNLEGNELQRHADEFLLDLGHHERSIMTDLYYLSQTDGAGDWREKEAKDLTELVQRRITYLQNPKDCSKAKKLVCNINKGCGYGCQLHHVVYCFMIAYGTQRTLILESQNWRYATGGWETVFRPVSETCTDRSGISTGHWSGEVKDKNVQVVELPIVDSLHPRPPYLPLAVPEDLADRLVRVHGDPAVWWVSQFVKYLIRPQPWLEKEIEEATKKLGFKHPVIGVHVRRTDKVGTEAAFHPIEEYMVHVEEHFQLLARRMQVDKKRVYLATDDPSLLKEAKTKYPNYEFISDNSISWSAGLHNRYTENSLRGVILDIHFLSQADFLVCTFSSQVCRVAYEIMQTLHPDASANFHSLDDIYYFGGQNAHNQIAIYAHQPRTADEIPMEPGDIIGVAGNHWDGYSKGVNRKLGRTGLYPSYKVREKIETVKYPTYPEAEK

SEQ ID NO: 153 - DNA, 1200 bp, Caenorhabditis elegans
atgccaaccggcaagtctgaatcttctgatatttctgaagttgttggtaacatggaaatatctaaagttgagggtcttgaagcgtgtatcggaatgagccacgaagtgtccactactccagctgctgagttggctgctttcagagcacgcaaggttgctctgattactggaatttctggacaagacggttcatatcttgctgagcttcttctttcaaaaggatacaaagttcacggaatcatccgtcgttcatcttcattcaataccgcaagaatcgaacatctgtacagtaatccaattactcatcacggtgattcttcattctctcttcactatggagatatgactgattcatcttgtctcatcaagctcatttcaactatcgagccaaccgaagtgtatcatttggctgctcaatctcacgtcaaagtgtcttttgatttgccagaatacactgctgaagtagacgctgttggaactcttcgccttctcgatgcaatccatgcttgtcgtttgactgaaaaagttcgattctatcaagcatccacatccgaattgtatggaaaagttcaagagattccacaaagtgagaagactccattctatccaagatctccatatgctgttgccaagatgtacgggtactggattgttgttaactatcgtgaagcctacaatatgtttgcttgcaatggaattttgttcaaccatgagagtccaagaagaggagagacattcgtgactcgtaagatcactcgttcagtcgctaaaatcagtttggggcaacaggaaagcattgagctcggaaatctgagtgctcttcgtgattggggacacgccagagagtatgttgaagcaatgtggagaattcttcaacacgactcaccagatgattttgtgattgcaactggaaaacaattcagtgtcagagagttttgtaatcttgcatttgctgaaattggagaagtattgcaatgggaaggagaaggtgttgaggaagttggaaagaataaagatggagttattcgagttaaagttagtccaaagtactacagaccaactgaagtggagactttattgggaaatgctgaaaaagcaaagaagactcttggatgggaagcaaaggttacggttccggaactcgtcaaagagatggttgcaagcgacattatccttatgaagtccaatccaatggcttaa

SEQ ID NO: 154 - DNA, 1146 bp, Helicobacter pylori
atgaaagagaagatcgccctcattaccggcgtcacgggccaggacggtagctacctggctgagtacctcctgaaccttggatatgaagtgcacggcttgaagcgccgatcctcgagcatcaacacttctcggatcgatcacctctacgaggacctccattccgagcacaagcgccgtttctttctgcactacggcgacatgaccgactcgtcaaatctgatccacctcattgccaccacgaagcccacagagatctacaaccttgccgcgcagagccatgtcaaggttagtttcgaaacccctgagtatacggccaacgcagatggcattgggactctcaggatcttggaggctatgcgcatcctgggcctcgagaagaaaaccagattctaccaagcctccacgtctgagctgtacggtgaggtcctggaaaccccgcagaacgagaacacaccctttaacccccgcagcccatacgccgtcgcgaagatgtacgctttctatattacgaagaattaccgagaggcctacaacctctttgcagtgaacggaatccttttcaaccacgagtcgcgcgtccggggcgaaaccttcgttacccgtaagattactagggccgcctccgctatcgcgtacaacctcacggactgcctgtatctgggcaatttggacgccaagcgcgattggggccacgccaaggactacgtcaagatgatgcacctcatgctccaggcacctaccccgcaggactacgtgatcgccaccggtaagactacaagcgtccgagacttcgtcaagatgtccttcgagtttatcggcattgatcttgagtttcagaacacgggaatcaaagagattggcctgatcaagtcggttgacgagaagcgcgcgaacgcgctccaactcaacctgtctcatctcaagaccgggaagatcgtcgtgcggattgacgaacactatttccgccccactgaggtcgacctgttgctgggcgatcccacgggtgccgagaaagagcttggctgggtccgagagtacgacctcaaagaactggtgaaggacatgctcgagtacgatctgaaagagtgccagaagaacctctacttgcaggacggcggatatacccttcggaatttctacgagtaa

SEQ ID NO: 155 - protein, 380 aa, Loa loa
MNTEALEDCLGNRHSMKPISEVEKCKFRTPKIALITGISGQDGSYLAELLLSKGYEVHGIIRRSSSFNTSRIEHLYSNPVTHHADSSFTLHYGDMTDSSCLIKLVSQIQPTEVYHLAAQSHVKVSFDLPEYTAEVDAVGTLRLLDSIHACGLTNKVRFYQASTSELYGKVQEVPQKETTPFYPRSPYAAAKLYSYWIVVNYREAYNMFACNGILFNHESPRRGETFVTRKITRAVAKIALGQQEILELGNLSSSRDWGHAKEYVEAMWKILQYDQPDDFVIATGKSYTVRRFAELAFEEIGKTIIWEGEGVHEVGKEKDTGIIRVRVSPKYYRPTEVDLLIGDPTKAKQKLNWEAKITLEELVKEMVASDLQLMKSNPMA

SEQ ID NO: 156 - protein, 387 aa, Brugia malayi
MTINATKMNTETQENCLGNRSSMKTISEVERYKCRARKIALITGISGQDGSYLAELLLSKGYEVHGIIRRSSSFNTARIEHLYSNPITHHADSSFTLHYGDMTDSSCLIKIVSQIQPTEVYHLAAQSHVKVSFDLPEYTAEVDAVGTLRLLDSIHACGLTNKVKFYQASTSELYGKVQEVPQKETTPFYPRSPYAAAKLYSYWIVVNYREAYSMFACNGILFNHESPRRGETFVTRKITRAVAKIALGQQEVLELGNLSSSRDWGHAKEYVEAMWRILQYDKPDDFVIATGKSYTVRRFAELAFEEIGKKIIWEGEGVHEVGKEEDTGIVRVRVSSKYYRPTEVDLLIGDSTKAKQKLNWEAKTTLEELVKEMVASDLQLMKSNPMA

SEQ ID NO: 157 - protein, 362 aa, Anopheles gambiae
MEGEAAVTNPVDRKVALITGITGQDGSYLAEFLLDKGYEVHGIIRRASTFNTSRIEHLYADPRTHREGKMKLHYGDMTDSSALVKIIAQVRPSEIYNLAAQSHVKISFDLSEYTAEVDAVGTLRLLDAIRTVGQERTVRFYQASTSELYGKVAETPQNEKTPFYPRSPYACAKMYGYWIVINYREAYDMFACNGILFNHESPRRGENFVTRKITRSVAKISLGQQEYLELGNLDSKRDWGHAKDYVEAMWLMMQQERPEDFVIATGETHSVREFVEQAFRYIGREIEWRGTGVDEVGVEKGTDTVRVRINPKFFRPTEVDLLLGDASKAKAQLGWSPKVTFLELIADMMAADIQLMKNNPSA

SEQ ID NO: 158 - protein, 382 aa, Aedes aegypti
MSLENGSNKKRRLSLENHLATESEGSSSSDPNRRVALITGITGQDGSYLAEFLLKKDYEVHGIIRRASTFNTSRIEHLYADPHSHKQGKMKLHYGDMTDSSCLVKIISSVRPSEIYNLAAQSHVKVSFDLSEYTAEVDAVGTLRLLDAIRTCGLEKSVRFYQASTSELYGKVVETPQNEKTPFYPRSPYACAKMYGYWIVINYREAYNMFACNGILFNHESPRRGENFVTRKITRSVAKISLNQMDCLELGNLDSKRDWGHAQDYVEAMWMMLQQPQPQDYVIATGECHSVREFVEHSFRHIGREIEWRGEGLNEVGVEKGTDTVRVRINPKFFRPTEVDLLLGDASKAKRELGWTPKVSFLQLVSDMMVADIELMKKNPNA

SEQ ID NO: 159 - protein, 370 aa, Danio rerio
MAQCTATTTGGGMNGDSKRKRKVAIITGITGQDGSYLAELLLAKGYEVHGILRRSSSFNTGRIEHLYHNPQTHTEGNMKLHYGDLTDSTCLVKIINEVKPTEIYNLGAQSHVKISFDLAEYTADVDGVGTLRLLDAVKTCGLTDTVRFYQASTSELYGKVQEIPQKETTPFYPRSPYGAAKLYAYWIVINFREAYNLFAVNGILFNHESPRRGSNFVTRKISRSVAKIHLGQLECFSLGNLDSMRDWGHAKDYVEAMWLMLQQEEPVDFVIATGEVHSVREFVERAFKHVGKTIVWEGKDEKEVGRCQETGVIHVRVDPKYYRPTEVDYLQGDSSKAFKVLGWKPRVTFEELVKEMVDADIKLMQNNPNA

SEQ ID NO: 160 - protein, 370 aa, Salmo salar
MAQCTEPSTSTGANGELKKPRKVAVITGITGQDGSYLAEFLLEKGYEVHGILRRSSSFNTGRIEHLYQNPQTHTEGNMKLHYGDLTDSTCLVKIINQVKPTEIYNLGAQSHVKISFELAEYTANVDGVGTLRLLDAIKTCGLTNSVKFYQASTSELYGKVQEIPQKETTPFYPRSPYGAAKLYAYWIVVNFREAYNLFAVNGILFNHESPRRGANFVTRKISRSVAKIHLGQLESFSLGNLDSKRDWGHAKDYVEAMWLMLQQEEPEDLVIATGEVHSVREFVEKSFKHVGKTIVWEGKDENEVGRCQETGVIHVKVDSKYYRPTEVEYLQGDSTKALTKLGWKAKITFEELVKEMVDADIHLMKNNPNA

SEQ ID NO: 161 - protein, 358 aa, Apis mellifera
MKMATDSRRRVALITGITGQDGSYLAEFLLEKGYDVHGIIRRASSFNTARIQHLYEDPKCHRQGKMKLHYGDMTDSSSLIKVISSVQPTEIYNLAAQSHVMVSFEVSEYTAEVDAVGTVRLLDAIRTCGLEKSVKFYHASTSELYGRVTQVPQNEKTPFYPRSPYACAKLYSFWIVINYREAYNMFACNGILFNHESPRRGENFVTRKVTRSIAKIHLGLQDILELGNLDAKRDWGHAKDYVEAMWLMLQQPTADDYVIATGETHSVREFVEAAFQYVGRTIKWEGEGINEIGQDVQTGQVLVKVNPKYFRPTEVDVLLGDATKAKEKIGWKPTITFENLVKDMMDSDLELMSKNPNA

SEQ ID NO: 162 - protein, 395 aa, Drosophila melanogaster
MLNTRLIAMSTSDGAPETKKQRPESSSNGSKDQNGTEAGAEGDSRDKVALITGITGQDGSYLAEFLLKKDYEVHGIIRRASTFNTTRIEHLYADPKAHKGGRMKLHYGDMTDSSSLVKIINMVKPTEIYNLAAQSHVKVSFDLSEYTAEVDAVGTLRILDAIRTCGMEKNVRFYQASTSELYGKVVETPQNEQTPFYPRSPYACAKMYGFWIVINYREAYNMYACNGILFNHESPRRGENFVTRKITRSVAKIYHKQMEYFELGNLDSKRDWGHASDYVEAMWMMLQRESPSDYVIATGETHSVREFVEAAFKHIDREITWKGKGVDEVGVENGTGIVRVRINPKYFRPTEVDLLQGDASKANRELNWTPKVTFVELVSDMMKADIELMRKNPIA

SEQ ID NO: 163 - protein, 369 aa, Xenopus laevis
MAQNQGNCSCSPSNSSGKPRKVALITGITGQDGSYLAEFLLEKGYEVHGIVRRSSSFNTGRIEHLYKNPHAHTEGNMKLHYGDLTDSTCLVKIINEVKPTEIYNLGAQSHVKISFDLAEYTADVDGLGTLRLLDATKTCGLINTVKFYQASTSELYGKVQEIPQKETTPFYPRSPYGAAKLYAYWIVVNFREAYNLFAVNGILFNHESPRRGANFVTRKISRSVAKIHLGQMESFSLGNLDAKRDWGHAKDYVEAMWLMLQTDEPEDFVISTGEVHSVREFVEKAFKHIGKTIVWEGKNENEVGRCSETGKIHVKVDLKYYRPTEVDFLQGDCSQAKNKLGWTPKVSFDELVKEMVESDVKLMATNPNA

SEQ ID NO: 164 - protein, 372 aa, Bos taurus
MAQAAAHYPGACGAGDAETGKPRKVALITGITGQDGSYLAEFLLEKGYEVHGIVRRSSSFNTGRIEHLYKNPQAHIEGNMKLHYGDLTDSTCLVKIINEVKPTEIYNLGAQSHVKISFDLAEYTADVDGVGTLRLLDAVKTCGLISSVRFYQASTSELYGKVQEIPQKETTPFYPRSPYGAAKLYAYWIVVNFREAYNLFAVNGILFNHESPRRGANFVTRKISRSVAKIHLGQLECFSLGNLDAKRDWGHAKDYVEAMWLMLQKDEPEDFVIATGEVHSVREFVEKSFLHIGKTIVWEGKNENEVGRCKETGKIHVTVDLKYYRPTEVDFLQGDCSKARQKLSWKPRVAFDELVREMVEADVELMRTNPHA

SEQ ID NO: 165 - protein, 372 aa, Cricetulus griseus
MAHAPASCPSSRNSGDGDKGKPRKVALITGITGQDGSYLAEFLLEKGYEVHGIVRRSSSFNTGRIEHLYKNPQAHIEGNMKLHYGDLTDSTCLVKIINEVKPTEIYNLGAQSHVKISFDLAEYTADVDGVGTLRLLDAIKTCGLINSVKFYQASTSELYGKVQEIPQKETTPFYPRSPYGAAKLYAYWIVVNFREAYNLFAVNGILFNHESPRRGANFVTRKISRSVAKIYLGQLECFSLGNLDAKRDWGHAKDYVEAMWLMLQNDEPEDFVIATGEVHSVREFVEKSFMHIGKTIVWEGKNENEVGRCKETGKIHVTVDLKYYRPTEVDFLQGDCSKAQQKLNWKPRVAFDELVREMVQADVELMRTNPNA

SEQ ID NO: 166 - protein, 372 aa, Mus musculus
MAQAPAKCPSYPGSGDGEMGKLRKVALITGITGQDGSYLAEFLLEKGYEVHGIVRRSSSFNTGRIEHLYKNPQAHIEGNMKLHYGDLTDSTCLVKIINEVKPTEIYNLGAQSHVKISFDLAEYTADVDGVGTLRLLDAIKTCGLINSVKFYQASTSELYGKVQEIPQKETTPFYPRSPYGAAKLYAYWIVVNFREAYNLFAVNGILFNHESPRRGANFVTRKISRSVAKIYLGQLECFSLGNLDAKRDWGHAKDYVEAMWLMLQNDEPEDFVIATGEVHSVREFVEKSFMHIGKTIVWEGKNENEVGRCKETGKVHVTVDLKYYRPTEVDFLQGDCSKAQQKLNWKPRVAFDELVREMVQADVELMRTNPNA

SEQ ID NO: 167 - protein, 372 aa, Rattus norvegicus
MAHAPASCRRYPGSGDGEMGKLRKVALITGITGQDGSYLAEFLLEKGYEVHGIVRRSSSFNTGRIEHLYKNPQAHIEGNMKLHYGDLTDSTCLVKIINEVKPTEIYNLGAQSHVKISFDLAEYTADVDGVGTLRLLDAIKTCGLINSVKFYQASTSELYGKVQEIPQKETTPFYPRSPYGAAKLYAYWIVVNFREAYNLFAVNGILFNHESPRRGANFVTRKISRSVAKIYLGQLECFSLGNLDAKRDWGHAKDYVEAMWLMLQNDEPEDFVIATGEVHSVREFVEKSFMHIGKTIVWEGKNENEVGRCKETGKIHVTVDLKYYRPTEVDFLQGDCSKAQQKLNWKPRVAFDELVREMVQADVELMRTNPNA

SEQ ID NO: 168 - protein, 372 aa, Homo sapiens
MAHAPARCPSARGSGDGEMGKPRNVALITGITGQDGSYLAEFLLEKGYEVHGIVRRSSSFNTGRIEHLYKNPQAHIEGNMKLHYGDLTDSTCLVKIINEVKPTEIYNLGAQSHVKISFDLAEYTADVDGVGTLRLLDAVKTCGLINSVKFYQASTSELYGKVQEIPQKETTPFYPRSPYGAAKLYAYWIVVNFREAYNLFAVNGILFNHESPRRGANFVTRKISRSVAKIYLGQLECFSLGNLDAKRDWGHAKDYVEAMWLMLQNDEPEDFVIATGEVHSVREFVEKSFLHIGKTIVWEGKNENEVGRCKETGKVHVTVDLKYYRPTEVDFLQGDCTKAKQKLNWKPRVAFDELVREMVHADVELMRTNPNA

SEQ ID NO: 169 - protein, 373 aa, Ciona intestinalis
MADSSCNGKRKNGDSCDTETKKQKKTALVTGITGQDGSYLAELLIEKGYEVHGIIRRASQPNTARIEHLYADRATHKEGSMKLHYGDLTDSSCLVKIINQVKPNEIYNLGAMSHVKVSFDLAEYTADVDGVGTLRLLDAIRTCGMSDSVRFYQASTSEMFGKVQEIPQKETTPFYPRSPYAAAKVYAYWIVVNYREAYGMHASNGILFNHESPRRGFNFVTRKITRSVAKIHLGLQELITLGNLDSKRDWGHARDYVKGMWMMMQHDEPGDYVLSTNETHSVREFVEKSFKHIGVELEWQGEGVNEIGVDKSTGVKRVQISERYYRPTEVEFLLGDYSKAKKVLGWSPDIKFNELVKEMVEADINLMKKTPNA

SEQ ID NO: 170 - protein, 379 aa, Francisella philomiragia
MKKVALITGITGQDGSYLAEFLLKKGYIVHGIKRRSSLFNTDRIDHLYQDPHVENRNLILHYGDMTDSMNLTRVIADTQPDEIYNLAAMSHVHVSFETPEYVANADGTGTLRILEAVRLLGLEKKTKIYQASTSELYGKVQAIPQSETTPFYPRSPYAVAKMYAFWITVNYREAYDMFACNGILFNHESPVRGETFVTRKITRAASKIALNLQDKLYLGNLDAKRDWGHAKDYVRMMWMILQADQPEDWVIATGQTTTVRDFVKLSFAYAGINLRFEGEGVDEIGVVDSVDSARAERAGVDLSHISEGQVVVCVDPRYFRPTEVDLLLGDPTKAEQKLGWSREYDLEHLVNDMMESDLKLMTKDVYLKDGGYKIMSYFE

SEQ ID NO: 171 - protein, 379 aa, Campylobacter coli
MKKVALITGVTGQDGAYLSEFLLNKGYEVHGIKRRSSLFNTDRIDHLFEGHHNKKNDFYLHYGDMTDSMNLTRIIAEIKPDEIYNLAAMSHVHVSFETPEYTANADGIGTLRILDAVRFLNLTQKTKIYQASTSELFGKVQEIPQNEKTPFYPRSPYAVAKMYAYWITVNYREAYDMFACNGILFNHESPVRGETFVTRKITRATAKIALNLDDMLYLGNLDAKRDWGHAKDYVRMMWMILQHEKADDWVIATGKTTTVRDFVKLAFEYCGIKLNFKGVGVDEEGFIEDLDQQRAKELSLSFNHLQKGQVVVKVNPRYFRPTEVDLLLGDPSKAEKELGWNREYDLKNLVDDMMENDLKLMTKDVYLKQGGYKIMRYYE

SEQ ID NO: 172 - protein, 373 aa, Cellulophaga lytica
MSDKKVALITGVTGQDGAYLSEFLLKKGYEVHGLKRRSSLFNTDRIDHLYQDPHIENRNFILHYGDMTDSTNLIRLIQEIQPDEIYNLAAMSHVHVSFEVPEYTANADGIGTLRILDAVRMLGLSNKTRIYQASTSELYGKVQEVPQSETTPFYPRSPYAVAKMYAYWITVNYREAYNMYACNGILFNHESPIRGETFVTRKITRATAKIALGLQDKFYLGNLDAERDWGHAKDYVRMMWMILQADEPEDWVIATGKTTKVREFVKMSFAEAGIELEFKGSGVEEKAYVVKCSNPDYQLEIGKEVLSVDPKYFRPTEVELLIGDPTKAKTKLGWTVEYELADLVKDMVQSDLKLMQKEQYLKDGGYRILNYFE

SEQ ID NO: 173 - protein, 399 aa, caenorhabditis elegans
MPTGKSESSDISEVVGNMEISKVEGLEACIGMSHEVSTTPAAELAAFRARKVALITGISGQDGSYLAELLLSKGYKVHGIIRRSSSFNTARIEHLYSNPITHHGDSSFSLHYGDMTDSSCLIKLISTIEPTEVYHLAAQSHVKVSFDLPEYTAEVDAVGTLRLLDAIHACRLTEKVRFYQASTSELYGKVQEIPQSEKTPFYPRSPYAVAKMYGYWIVVNYREAYNMFACNGILFNHESPRRGETFVTRKITRSVAKISLGQQESIELGNLSALRDWGHAREYVEAMWRILQHDSPDDFVIATGKQFSVREFCNLAFAEIGEVLQWEGEGVEEVGKNKDGVIRVKVSPKYYRPTEVETLLGNAEKAKKTLGWEAKVTVPELVKEMVASDIILMKSNPMA

SEQ ID NO: 174 - protein, 381 aa, helicobacter pylori
MKEKIALITGVTGQDGSYLAEYLLNLGYEVHGLKRRSSSINTSRIDHLYEDLHSEHKRRFFLHYGDMTDSSNLIHLIATTKPTEIYNLAAQSHVKVSFETPEYTANADGIGTLRILEAMRILGLEKKTRFYQASTSELYGEVLETPQNENTPFNPRSPYAVAKMYAFYITKNYREAYNLFAVNGILFNHESRVRGETFVTRKITRAASAIAYNLTDCLYLGNLDAKRDWGHAKDYVKMMHLMLQAPTPQDYVIATGKTTSVRDFVKMSFEFIGIDLEFQNTGIKEIGLIKSVDEKRANALQLNLSHLKTGKIVVRIDEHYFRPTEVDLLLGDPTGAEKELGWVREYDLKELVKDMLEYDLKECQKNLYLQDGGYTLRNFYE

SEQ ID NO: 175 - DNA, 948 bp, Caenorhabditis elegans
atgaaaaccatcctcgtcacgggcggcactggtctggtgggaagcgccattaagaaggtcgttgagacaaccgagaagcgcgacgatgaaaagtgggtctttatcggctccaaggactgcgacctcgagaaccttgaggaaacgcgagagctgttcgagtcggtcaagcccacccacgtgatccatttggccgctatggtcgggggcctcttccacaacctcgcgcacaatctgcagttctttcggaagaacatggccatcaacgacaacgttctcgcactgtgccacgagttcgatgtcatcaagtgcgtgagctgcctttctacctgtatcttccctgacaagacgtcctacccgattgacgagactatggtccacctcggcccaccccatgactcaaactttggctactcgtatgccaagcgcatgatcgatgtcctgaacaagggttacgctcaagagcacggacgtaagtacaccagcgtggttccctgcaatgtctttggccctcacgacaactacaacttgcagtccggccatgtcctcccggccctgatccacaaggcctatgtcgcgcagagggacggcacgccccttcaggtgtacggcagtggtacacccctgcgccagttcatctactctattgatctcgctcgcctgttcattcgagtcgttagagaatacgaggacgtcgagcctatcatcctcagcgtgaacgagtccgacgaagtctcgattcgcgacgccgtcagcgccgtggttaaggcaatcgacttcaccggggacgtcgagtatgatacttccaaagcggatggacagttcaagaaaaccgcctcgaacgagaagctcctgaagttgtttccggacttccaattcacgccctttgagcaggctatccaagagtcagtccagtggttcgttgacaactacgaaaccgcccggaagtaa

SEQ ID NO: 176 - DNA, 933 bp, Helicobacter pylori
atgaacgagatcatcctcattaccggcgcctacggcatggtcggtcagaacacggctctgtacttcaagaagaacaagcccgacgttaccctccttactcctaagaaaagcgagctgtgcctcttggacaaggataatgtccaggcctacctgaaagaatataagccgacaggaatcattcactgcgcaggccgcgtcggcgggatcgtggcgaacatgaacgacctctccacgtacatggtcgagaaccttctcatgggcctgtacctgttttcgagcgccctcgactctggtgtgaagaaggccatcaacttggcctcatcctgtgcttatcccaagttcgcgcccaatccactgaaagagtcggatctgctcaacggcagcctcgagcctaccaacgagggatacgcccttgctaagctgtccgtcatgaagtactgcgaatacgttagtgccgagaagggcgtgttctataagaccctcgtcccgtgcaacttgtacggcgagttcgacaagtttgaagaaaagatcgcacacatgatccccggcctcattgcccgaatgcatacggcgaagctgaagaacgagaaagaatttgccatgtggggcgacggtactgctcgccgggagtacctcaacgccaaggatctggcccgtttcatttctcttgcatacgagaatatcgctagcattccctctgtcatgaacgtgggatcgggcgttgactatagcatcgaggaatactacgagaaggtcgcgcaagtgctcgactacaagggggtgttcgtcaaggacctgtccaagcctgtcggtatgcagcaaaagctcatggatatctcgaagcagagggctctgaagtgggagttggagattccgctcgagcagggcatcaaagaggcctacgagtactatctgaagctgcttgaggtgtaa

SEQ ID NO: 177 - protein, 320 aa, Ascaris suum
MASEKQMIVLVTGGTGLVGKAIEKIVKTEESRPNERWIFIGSKDCDLSDLEATRKLFAKHKPTHVIHLAAMVGGLFHNLQHNLQFFRKNMQINDNVLAVCDENDIEKCVSCLSTCIFPDKTTYPIDETMVHNGPPHDSNFGYSYAKRMIDVLNRGYAQERGRKYTSVVPCNVFGPYDNYNLEYGHVIPALIHKTFIAKRDGKPLEVFGSGAPLRQFIYSLDLARLFVWVLRNYEEIEPIILSVGEEDEVSIMDAVNAIVKAFDFKGGIVQDKSKADGQYKKTASNAKLRKYLPDFKFTPFDVAIKESVDWFVANYEDARK

SEQ ID NO: 178 - protein, 483 aa, Brugia malayi
MASSSRRLKKELTDIQSSDSRTFCCVEFDENNLLHWTGLLVPDKEPYNKGAFKVAIDFPVEYPFKPPKITFLTKIYHPNVDEKGQVCLPIISPDNWKPATKTEQVMNALLGLITEPEPDHPLRADLAEEFTKDRKKFNKTAEDYTKKYAVKRPDGWFETRHKIMDREQSMTVLVTGGTGLVGRSIEKIITTEEARPNETWIFVGRNDCDLTDIEATRKLFMKCRPSHVIHLAAMVGGLFHNLHCNLQFFRKNMQINDNVLMACNEFDVVKCISCLSTCVFPDKTTYPIDETMVHNGPPHSSNFGYSYAKRMIDVLNRGYAQEFGRKYTSVIPCNVFGPHDNYNLKDGHVIPALIHKTYIAKHEGTPLEVFGSGTPLRQFIYSLDLARLFIWVARSYEEIDPIILSVGEEDEVSIMDAVHAVVRAFDFKGEIVHDKTKADGQYKKTASNAKLRKYLPNFKFTPFEIAIKESVDWFIDNYDNARK

SEQ ID NO: 179 - protein, 323 aa, Gallus gallus
MTEALGAKPKRILVTGGTGLVGRAIQEVVANGEGRPDEEWVFVSSRDADLTSAVETKALFEKHKPTHVIHLAAMVGGLFKNIRCNLDFWRRNIHINDNVLHSAYECGVQKVVSCLSTCIFPDKTTYPIDETMIHNGPPHSSNFGYSYAKRMIDVQNRGYFEQHGCRFTAVIPTNVFGPHDNFNIEDGHVLPGLIHKVYLAKQNGSALTVWGTGKPRRQFIYSLDLARLFVWVLREYEEVEPIILSVGEEDEVSIREAAEAIVEAMDFRGELIFDTTKADGQFKKTASNAKLRHYLPNFQFTPFRQAVKETCTWFSTNYASARK

SEQ ID NO: 180 - protein, 320 aa, Danio rerio
MNGTVEPMRVLVTGGSGLVGRAIERVVKDEGREGEEWTFLSSKDANLLSAEETRAIFQKYRPTHVIHLAAMVGGLFRNMRQNLDFWRNNVFINDNVLQTANEFGVVKVVSCLSTCIFPDKTTYPIDETMIHNGPPHDSNFGYAFAKRMIDVQNRTCFKQYGRRYTSVIPTNVFGAHDNFNIDDGHVLPGLIHKTYLAKKEGKPLQVWGSGKPLRQFIYSLDLARLFLWVLREYDEVDPIILSVGEEDELSIKDCADAVVDALGFKGDVIYDTSKADGQFKKTASNAKLRQYLPDFQFTPFREAIKETCDWFVANYDIARK

SEQ ID NO: 181 - protein, 317 aa, Xenopus laevis
MEGKRILVTGGSGLVGKAIEKVVADGEGRPDEQWIFISSKDADLTNAADTKCLFEKHKPTHVIHLAAMVGGLFRNMKYNLDFLRNNLHINDNVLHSAYEMGVQKVVSCLSTCIFPDKTTYPIDETMIHNGPPHTSNFGYSYAKRMIDVQNRAYYEQHGCKFTSVIPTNVFGPHDNFNIDDGHVLPGLIHKVYSAKQNGTALSIWGTGQPRRQFIYSLDLARLFIWVLREYNEVDPIILSVGEEDEVSIKEAAESIVAAMEFKGELIFDSTKSDGQFKKTASNHKLRKYLPDFQFTPFNKAVQETCNWFNSNYAQARK

SEQ ID NO: 182 - protein, 321 aa, Bos taurus
MGDPRGTRRILVTGGSGLVGRAIQKVVEDGARLPGEDWVFVSSKDADLTDAAQTRALFQQVQPTHVIHLAAMVGGLFRNIKYNLDFWRKNIHINDNVLHSAFEVGVRKVVSCLSTCIFPDKTTYPIDETMIHNGPPHSSNFGYSYAKRMIDVQNRAYFQQHGCTFTAVIPTNVFGPHDNFSIEDGHVLPGLIHKVHLAKSSGSALTVWGTGRPRRQFIYSLDLARLFIWALREYDEVEPIILSVGEEDEVSVQEAAEAVVEAMDFHGEVTFDTTKSDGQFKKTASNAKLRAYLPDFRFTPFKQAVKETCAWFTDNYEQARK

SEQ ID NO: 183 - protein, 321 aa, Equus caballus
MGEPQGSMRILVTGSSGLVGRAIQKVVADGARLPGEDWVFVSSKDADLTDAAQTRALFEKVRPTHVIHLAAMVGGLFRNIKYNLDFWRKNVHINDNVLHSAFEVGARKVVSCLSTCIFPDKTTYPIDETMIHNGPPHSSNFGYSYAKRMIDVQNRAYFQQHGCTFTAVIPTNVFGPHDNFNIEDGHVLPGLIHKVHLAKSSGSALTVWGTGKPRRQFIYSLDLARLFIWVLREYNEVEPIILSVGEEDEVSIQEAAEAVVEAMDFHGDVTFDTTKSDGQFKKTASNGKLRAYLPDFRFTPFKQAVKETCAWFTDNYEQARK

SEQ ID NO: 184 - protein, 321 aa, Canis lupus
MSEPGGSVRILVTGGSGLVGRAIQKVVADGAGLPGEDWVFVSSKDADLTDAAQTRALFEKVRPTHVIHLAAMVGGLFRNIKYNLDFWRKNVHINDNVLHSAFEVGVRKVVSCLSTCIFPDKTTYPIDETMIHNGPPHNSNFGYSYAKRMIDVQNRAYFQQHGCTFTAVIPTNVFGPHDNFNIEDGHVLPGLIHKVHLAKSSGSALTVWGTGKPRRQFIYSLDLARLFIWVLREYNEVEPIILSVGEEDEVSIQEAAEAVVEAMDFHGEVTFDTTKSDGQFKKTASNGKLRTYLPDFRFTPFKQAVKETCAWFTHNYEQARK

SEQ ID NO: 185 - protein, 321 aa, Homo sapiens
MGEPQGSMRILVTGGSGLVGKAIQKVVADGAGLPGEDWVFVSSKDADLTDTAQTRALFEKVQPTHVIHLAAMVGGLFRNIKYNLDFWRKNVHMNDNVLHSAFEVGARKVVSCLSTCIFPDKTTYPIDETMIHNGPPHNSNFGYSYAKRMIDVQNRAYFQQYGCTFTAVIPTNVFGPHDNFNIEDGHVLPGLIHKVHLAKSSGSALTVWGTGNPRRQFIYSLDLAQLFIWVLREYNEVEPIILSVGEEDEVSIKEAAEAVVEAMDFHGEVTFDTTKSDGQFKKTASNSKLRTYLPDFRFTPFKQAVKETCAWFTDNYEQARK

SEQ ID NO: 186 - protein, 321 aa, Cricetulus griseus
MGEPQGSRRILVTGGSGLVGRAIQKVVADGAGLPGEEWVFVSSKDADLTDAAQTQALFQKVQPTHVIHLAAMVGGLFRNIKYNLDFWRKNVHINDNVLHSAFEVGTRKVVSCLSTCIFPDKTTYPIDETMIHNGPPHSSNFGYSYAKRMIDVQNRAYFQQHGCTFTAVIPTNVFGPHDNFNIEDGHVLPGLIHKVHLAKSNGSALTVWGTGKPRRQFIYSLDLARLFIWVLREYNEVEPIILSVGEEDEVSIKEAAEAVVEAMDFCGEVTFDSTKSDGQYKKTASNGKLRAYLPDFRFTPFKQAVKETCAWFTDNYEQARK

SEQ ID NO: 187 - protein, 321 aa, Rattus norvegicus
MGEPHGSMRILVTGGSGLVGRAIQKVVADGAGLPGEEWVFVSSKDADLTDAAQTQALFQKVQPTHVIHLAAMVGGLFRNIKYNLDFWRKNVHINDNVLHSAFEVGTRKVVSCLSTCIFPDKTTYPIDETMIHNGPPHSSNFGYSYAKRMIDVQNRAYFQQHGCTFTSVIPTNVFGPYDNFNIEDGHVLPGLIHKVHLAKSSGSALTVWGTGKPRRQFIYSLDLARLFIWVLREYNEVEPIILSVGEEDEVSIKEAAEAVVEAMDFSGEVTFDSTKSDGQYKKTASNGKLRSYLPDFCFTPFKQAVKETCAWFTENYEQARK

SEQ ID NO: 188 - protein, 321 aa, Mus musculus
MGEPHGSMRILVTGGSGLVGRAIQKVVADGAGLPGEEWVFVSSKDADLTDAAQTQALFQKVQPTHVIHLAAMVGGLFRNIKYNLDFWRKNVHINDNVLHSAFEVGARKVVSCLSTCIFPDKTTYPIDETMIHNGPPHSSNFGYSYAKRMIDVQNRAYFQQHGCTFTAVIPTNVFGPYDNFNIEDGHVLPGLIHKVHLAKSSDSALTVWGTGKPRRQFIYSLDLARLFIWVLREYSEVEPIILSVGEEDEVSIKEAAEAVVEAMDFNGEVTFDSTKSDGQYKKTASNGKLRSYLPDFRFTPFKQAVKETCTWFTDNYEQARK

SEQ ID NO: 189 - protein, 315 aa, Caenorhabditis elegans
MKTILVTGGTGLVGSAIKKVVETTEKRDDEKWVFIGSKDCDLENLEETRELFESVKPTHVIHLAAMVGGLFHNLAHNLQFFRKNMAINDNVLALCHEFDVIKCVSCLSTCIFPDKTSYPIDETMVHLGPPHDSNFGYSYAKRMIDVLNKGYAQEHGRKYTSVVPCNVFGPHDNYNLQSGHVLPALIHKAYVAQRDGTPLQVYGSGTPLRQFIYSIDLARLFIRVVREYEDVEPIILSVNESDEVSIRDAVSAVVKAIDFTGDVEYDTSKADGQFKKTASNEKLLKLFPDFQFTPFEQAIQESVQWFVDNYETARK

SEQ ID NO: 190 - protein, 310 aa, Helicobacter pylori
MNEIILITGAYGMVGQNTALYFKKNKPDVTLLTPKKSELCLLDKDNVQAYLKEYKPTGIIHCAGRVGGIVANMNDLSTYMVENLLMGLYLFSSALDSGVKKAINLASSCAYPKFAPNPLKESDLLNGSLEPTNEGYALAKLSVMKYCEYVSAEKGVFYKTLVPCNLYGEFDKFEEKIAHMIPGLIARMHTAKLKNEKEFAMWGDGTARREYLNAKDLARFISLAYENIASIPSVMNVGSGVDYSIEEYYEKVAQVLDYKGVFVKDLSKPVGMQQKLMDISKQRALKWELEIPLEQGIKEAYEYYLKLLEV

SEQ ID NO: 191 - DNA, 1092 bp, Caenorhabditis elegans
atgaagctccacgaggaaaacaacaaggccctgttcgaggctatgcgcaaccgagagaatcccaccaagtgggagagctacaagcaggtcatcacggccgtgtccgcgtactgggtcttttcgattggcctcgttttcctgaacaagtatcttttgtctagcgtccagctcgacgcccctctgttcatcacttggtatcaatgcctcgtcaccgtgttcctctgcctgtttctttcaaagacatccaaggcatacggtctgttcaaatttccctcgatgccgatcgatgccaagattagccgtgaggtcctcccattgtccgtcgtgttcgttgctatgatcagtttcaacaacctctgtctgaagtacgtcggcgtttctttttactacgtcggacgcagcctgaccacggtgttcaacgtcgtctgcacctacctcatccttggccagaaaacgtcgggccaggccattgggtgctgcgcgctgatcatcttcggctttctcttgggtgtggaccaggaaggcgtcaccggaacgctgtcctacactggcgtcattttcggcgttctcgccagcctctccgtcgccctgaatgctatctatacccgtaaggtcctttcgtcagtgggcgactgtctgtggaggctcacaatgtacaacaacctcaacgcactcgttctgtttctgccccttatgttgttcaacggcgagttcggtgccgtcttttacttcgacaagctctttgataccactttctggattctcatgacgctgggcggagtgttcggcttcatgatgggctacgtcaccgggtggcagatccaagcgaccagccctctcacgcacaatatctctggtactgccaaggccgctgcccagacagtcatggcagtcgtttggtattccgagcttaagaccctgttgtggtggacgtcgaacttcgtcgtgctgtttggcagcggaatgtacacctacgtgcaaaagcgcgtcatggacaagaagaactccggcgccagcccggcttcggaggcgaagtctgacaaggtcaagctcctgggcagagatggtaacgccgccgaggaatccgtttaa

SEQ ID NO: 192 - protein, 385 aa, Ascaris suum
MHHDSKITPVATIHLLPKGLGRGLLLQQFAMKNGRQHETLAQKSIKIVLAVSAYWICSIGLVFLNKYLLSSENLKLNAPLFITWYQCLVTVVLCYTCSYLSRIFPSRFSFPSIAFDHRISREVLPLSFVFVAMITTNNLCLKYVGVSFYYVGRSLTTVFNVVCSYLILGQGTSWRALLCCAVIIGGFFLGVDQEDAAGSLSVLGVVYGVAASLCVALNAIYTQRTLPAVGDSVARLTMYNNTNAVVLFIPLMLFSGEFGEIIYFPYLLSTHFWALMTISGVFGFLMGYVTGWQIQVTSPLTHNISGTAKAAAQTVIAVAWWQEVKSVLWWVSNVVVLGGSAAYTAVKRKEMIANHESNAKPRGSVSPDREPILSSKSSGDTSEDV

SEQ ID NO: 193 - protein, 331 aa, Loa loa
MSKYSLSSSYTGKLLNAPLFVTWYQCFVTVLLCCVFCWVSKQYPSLVTFPFVGFDHRISREVLPLSFVFVAMIATNNLCLKYVGVSFYYIGRSLTTVFNVICSYIILGQLTSLKTILCCALIIGGFVLGVDQEDATAQFFLPRTFLGTLSVTGVIFGVAASMFVALNAIYTQRTLPSVGDSITQLTLYNNINALVLFIPVMLFSGDISEVFYFRYSSSLRFWTLMTLSGIFGFLMSYVTGWQIQVTSSLTHNISGTAKAAAQTVIAVVWWQEMKSLLWWISNVIVLGGSAIYTMIKRKEMVDKYDTNKSKLNENIERQAVLFGLSDEDETV

SEQ ID NO: 194 - protein, 363 aa, Rattus norvegicus
MNRVPLKRSRILRMALTGASAVSEEADSENKPFLLRALQIALVVSLYWVTSISMVFLNKYLLDSPSLQLDTPIFVTFYQCLVTSLLCKGLSTLATCCPGMVDFPTLNLDLKVARSVLPLSVVFIGMITFNNLCLKYVGVAFYNVGRSLTTVFNVLLSYLLLKQTTSFYALLTCAIIIGGFWLGIDQEGAEGTLSLTGTIFGVLASLCVSLNAIYTKKVLPAVDHSIWRLTFYNNVNACVLFLPLMVVLGELHALLAFAHLNSAHFWVMMTLGGLFGFAIGYVTGLQIKFTSPLTHNVSGTAKACAQTVLAVLYYEEIKSFLWWTSNLMVLGGSSAYTWVRGWEMQKTQEDPSSKEGEKSAIGV

SEQ ID NO: 195 - protein, 365 aa, Cricetulus griseus
MNRAPLKRSRILRMALTGGSTASEEADEDSRNKPFLLRALQIALVVSLYWVTSISMVFLNKYLLDSPSLQLDTPIFVTFYQCLVTSLLCKGLSTLATCCPGTVDFPTLNLDLKVARSVLPLSVVFIGMISFNNLCLKYVGVAFYNVGRSLTTVFNVLLSYLLLKQTTSFYALLTCGIIIGGFWLGIDQEGAEGTLSLIGTIFGVLASLCVSLNAIYTKKVLPAVDNSIWRLTFYNNVNACVLFLPLMVLLGELRALLDFAHLYSAHFWLMMTLGGLFGFAIGYVTGLQIKFTSPLTHNVSGTAKACAQTVLAVLYYEETKSFLWWTSNLMVLGGSSAYTWVRGWEMQKTQEDPSSKEGEKSAIRV

SEQ ID NO: 196 - protein, 363 aa, Mus musculus
MNRAPLKRSRILRMALTGVSAVSEESESGNKPFLLRALQIALVVSLYWVTSISMVFLNKYLLDSPSLQLDTPIFVTFYQCLVTSLLCKGLSTLATCCPGMVDFPTLNLDVKVARSVLPLSVVFIGMITFNNLCLKYVGVPFYNVGRSLTTVFNVLLSYLLLKQTTSFYALLTCGVIIGGFWLGIDQEGAEGTLSLTGTIFGVLASLCVSLNAIYTKKVLPAVDHSIWRLTFYNNVNACVLFLPLMIVLGELRALLAFTHLSSAHFWLMMTLGGLFGFAIGYVTGLQIKFTSPLTHNVSGTAKACAQTVLAVLYYEEIKSFLWWTSNLMVLGGSSAYTWVRGWEMQKTQEDPSSKDGEKSAIRV

SEQ ID NO: 197 - protein, 350 aa, Mus musculus
MALTGVSAVSEESESGNKPFLLRALQIALVVSLYWVTSISMVFLNKYLLDSPSLQLDTPIFVTFYQCLVTSLLCKGLSTLATCCPGMVDFPTLNLDLKVARSVLPLSVVFIGMITFNNLCLKYVGVPFYNVGRSLTTVFNVLLSYLLLKQTTSFYALLTCGVIIGGFWLGIDQEGAEGTLSLTGTIFGVLASLCVSLNAIYTKKVLPAVDHSIWRLTFYNNVNACVLFLPLMIVLGELRALLAFTHLSSAHFWLMMTLGGLFGFAIGYVTGLQIKFTSPLTHNVSGTAKACAQTVLAVLYYEEIKSFLWWTSNLMVLGGSSAYTWVRGWEMQKTQEDPSSKDGEKSAIRV

SEQ ID NO: 198 - protein, 365 aa, Gallus gallus
MSRSQLTRTGILRMALGGAADPLLPAEGAGGRRTPFVLRALRIALVVSLYWFVSITMVFLNKYLLDSPSLRLDAPLFVTFFQCAVTAALCLGLSLGAACGPCAALPALRLDLKVSRSVLPLSVVFIGMVTSNNLCLKHVGVAFYNVGRSLTTVFNVLLSYLLLKQTTSLYALLACGIIIGGFWLGVDQEGAEGTLSWTGIIFGILASLCVSLNAIYTKKVLPVVDGSIWHLTFYNNMNACVLFLPLMMITGEFHTLYHFDKLGSPSFWGMMTLGGVFGFAIGYVTGLQIKFTSPLTHNVSGTAKACAQTVLAVVYFEETKSLLWWTSNLMVLGGSFAYTWVKGLEMRKAQEDPNLKSSEKNETGV

SEQ ID NO: 199 - protein, 362 aa, Xenopus tropicalis
MNFKRSSILRMALMGAGEGDQEKVSRESFLVRAVKIALVVTLYWFISITMVFLNKYLLDSPSLKLDAPLFVTFYQCVVTVVLCKGLSLLTHVVPSHILEFPSLRFDLKVLRTVLPLSIVFIGMITFNNLCLKYLGVAFYTVGRCLSTVFNVLLSYIMLKQTTSMYALMSCGVILGGFWLGIDQEGAEGTLSWAGIFFGVLASLCVSLNAIYTKKVLPAVDGSIWRLTFYNNVNACFLFTPLLFIFGEVGTLFTFDKLFAFSFWGMMTLGGIFGFAIGYVTGLQIQFTSPLTHNISGTAKACAQTVLAVMYYHQIKSFLWWTSNLMVLGGSFSYTWVKGLEMKKSQGETNQSQSNGEKNSVGV

SEQ ID NO: 200 - protein, 348 aa, Danio rerio
MAFTDSTRPGDKEEPFFMRATKIALVVTLYWFISISMVFLNNYLLDSKELDAPVFITFFQCVVSVGLCLLMSFLSSLCPGSVDFPSLKFDLRVSREILPLTIVFISMITFNNLCLKYVGVAFYTVGRSLSTVFNVILSYVVLKQTTSLYAVLCCGVILGGFWLGVDQEAVAGSLSWAGVVFGVIASLCVSLNAIFTKKVLPVVDGNIWKLSYYNNLNAIVLFLPLLIILGEVKSVFEFSRLTDLHFWGMMTLGGVFGFAIGYVTGLQIKFTSPLTHNVSGTAKSCAQTVLAVVYWASEKSTLWWTSNLMVLGGSFAYTWVKGMEMKKAPVPTETQSLNPQKNKEDLGV

SEQ ID NO: 201 - protein, 364 aa, Bos taurus
MNRASLKRSKILHMALMGTSDPSGEAEASQEKPFVLRALQIALVVSLYWVTSISMVFLNKYLLDSPSLRLDTPIFVTFYQCLVTVLLCKGLSSLATCCPGTVDFPALHLDLKVARSVLPLSVVFIGMITFNNLCLKYVGVAFYNVGRSLTTVFNVLLSYLLLKQTTSFYALLTCSVIIGGFWLGVDQEGAEGTLSWTGTLFGVLASLCVSLNAIYTKKVLPAVDGSIWRLTFYNNANACVLFLPLLLALGELRALLAFPQLGSAHFWAMMTLGGLFGFAIGYVTGLQIKFTSPLTHNVSGTAKACAQTVLAVLYYEEAKSFLWWTSNMMVLGGSSAYTWVRGREMKKTQEEPHPRENEKSNMEV

SEQ ID NO: 202 - protein, 364 aa, Canis lupus
MNRAPLKRSRILHMALMGASDPLGEAEAIKEKPFLLRALQITLVVSLYWVTSISMVFLNKYLLDSPSLQLDTPIFVTFYQCLVTTLLCKSLSTLAAFCPGAMDFPTLRLDLRVARSVLPLSVVFIGMITFNNLCLKYVGVAFYNVGRSLTTVFNVLLSYLLLKQTTSFYALLTCGIIIGGFWLGVDQEGAEGTLSWTGTLFGVLASLCVSLNAIYTKKVLPAVDGSIWRLTFYNNVNACVLFLPLLLLLGELQTLLNFSQLGSAHFWGMMTLGGLFGFAIGYVTGLQIKFTSPLTHNVSGTAKACAQTVLAVLYYEETKSFLWWTSNMMVLGGSSAYTWVRGWEMKKIQEDPSPKEDEKSSMGV

SEQ ID NO: 203 - protein, 364 aa, Homo sapiens
MNRAPLKRSRILHMALTGASDPSAEAEANGEKPFLLRALQIALVVSLYWVTSISMVFLNKYLLDSPSLRLDTPIFVTFYQCLVTTLLCKGLSALAACCPGAVDFPSLRLDLRVARSVLPLSVVFIGMITFNNLCLKYVGVAFYNVGRSLTTVFNVLLSYLLLKQTTSFYALLTCGIIIGGFWLGVDQEGAEGTLSWLGTVFGVLASLCVSLNAIYTTKVLPAVDGSIWRLTFYNNVNACILFLPLLLLLGELQALRDFAQLGSAHFWGMMTLGGLFGFAIGYVTGLQIKFTSPLTHNVSGTAKACAQTVLAVLYYEETKSFLWWTSNMMVLGGSSAYTWVRGWEMKKTPEEPSPKDSEKSAMGV

SEQ ID NO: 204 - protein, 351 aa, Homo sapiens
MALTGASDPSAEAEANGEKPFLLRALQIALVVSLYWVTSISMVFLNKYLLDSPSLRLDTPIFVTFYQCLVTTLLCKGLSALAACCPGAVDFPSLRLDLRVARSVLPLSVVFIGMITFNNLCLKYVGVAFYNVGRSLTTVFNVLLSYLLLKQTTSFYALLTCGIIIGGFWLGVDQEGAEGTLSWLGTVFGVLASLCVSLNAIYTTKVLPAVDGSIWRLTFYNNVNACILFLPLLLLLGELQALRDFAQLGSAHFWGMMTLGGLFGFAIGYVTGLQIKFTSPLTHNVSGTAKACAQTVLAVLYYEETKSFLWWTSNMMVLGGSSAYTWVRGWEMKKTPEEPSPKDSEKSAMGV

SEQ ID NO: 205 - protein, 363 aa, Caenorhabditis elegans
MKLHEENNKALFEAMRNRENPTKWESYKQVITAVSAYWVFSIGLVFLNKYLLSSVQLDAPLFITWYQCLVTVFLCLFLSKTSKAYGLFKFPSMPIDAKISREVLPLSVVFVAMISFNNLCLKYVGVSFYYVGRSLTTVFNVVCTYLILGQKTSGQAIGCCALIIFGFLLGVDQEGVTGTLSYTGVIFGVLASLSVALNAIYTRKVLSSVGDCLWRLTMYNNLNALVLFLPLMLFNGEFGAVFYFDKLFDTTFWILMTLGGVFGFMMGYVTGWQIQATSPLTHNISGTAKAAAQTVMAVVWYSELKTLLWWTSNFVVLFGSGMYTYVQKRVMDKKNSGASPASEAKSDKVKLLGRDGNAAEESV

SEQ ID NO: 206 - protein, 406 aa, Trichoderma reesei
MASTNARYVRYLLIAFFTILVFYFVSNSKYEGVDLNKGTFTAPDSTKTTPKPPATGDAKDFPLALTPNDPGFNDLVGIAPGPRMNATFVTLARNSDVWDIARSIRQVEDRFNRRYNYDWVFLNDKPFDNTFKKVTTSLVSGKTHYGEIAPEHWSFPDWIDQDKAKKVREDMAERKIIYGDSVSYRHMCRFESGFFFRQPLMMNYEYYWRVEPSIELYCDIHYDPFRLMVEQGKKYSFVISLYEYPATIATLWESTKKFMKNHPEHIAPDNSMRFLSDDGGETYNNCHFWSNFEIGSLEWLRSKQYIDFFESLDKDGGFFYERWGDAPVHSIAAGLMLNRSEIHFFNDIAYWHVPFTHCPTGEKTRLDLKCHCDPKENFDWKGYSCTSRFFEMNGMDKPEGWENQQD

SEQ ID NO: 207 - DNA, 1431 bp, Trichoderma reesei
atggcgtcaacaaatgcgcgctatgtgcgctatctactaatcgccttcttcgtacgtcaccctacagactcgacacctctgtcccctatgcagttgttgctaacatagaagaatagacaatcctcgtcttctactttgtctccaattcaaagtatgagggcgtcgatctcaacaagggcaccttcacagctccggattcgaccaagacgacaccaaagccgccagccactggcgatgccaaagactttcctctggccctgacgccgaacgatccaggcttcaacgacctcgtcggcatcgctcccggccctcgaatgaacgccacctttgtcaccctcgcccgaaacagcgacgtctgggacattgcacgctcgatccgccaggtcgaggatcgcttcaaccgacggtacaactacgactgggtgttcctcaacgacaagccgtttgacaacaccttcaagaaggtcacgacgtccctggtgtcgggcaagacgcactatggcgagattgcgcccgagcactggtcgttccccgactggatcgaccaggacaaggccaagaaggtgcgcgaggacatggctgagcgcaaaatcatctacggcgactcggtcagctaccgccacatgtgccgcttcgagtcgggcttcttcttccgccagccgctgatgatgaactacgaatactactggcgcgtggagccctccatcgagctctactgcgacatccactacgaccccttccgcctgatggttgagcagggcaaaaagtacagcttcgtcatcagcctgtacgagtacccggccacgattgccacgctgtgggagagcaccaagaagtttatgaagaaccatccggagcacattgcccccgacaactcgatgcgcttcctgagcgatgacggcggcgagacgtacaacaactgccacttcgtaagcttccctgcccgttgacttttctctctctctcttttgtctgccttccacccggcaacatgatggctaacatgaggatagtggtccaactttgagattggcagcctggagtggctgcgcagcaagcagtacattgactttttcgagtccctggacaaggacggcggcttcttctacgagcgatggggcgacgctcccgtccactccattgccgccggcctgatgctcaacaggagcgagattcacttcttcaacgacattgcctactggcatgtgccctttacccactgccccacgggcgagaagacgagactggatctgaaatgccactgcgaccccaaggagaactttgattggaagggctactcttgtaagcgctctagatacctttgtgccaacagaaatctgtgactaacacgcctctgtcataggcacatcccgattctttgagatgaacggcatggacaagcccgaaggctgggagaaccagcaagactaa

SEQ ID NO: 208 - protein, 85 aa, Trichoderma reesei
MASTNARYVRYLLIAFFTILVFYFVSNSKYEGVDLNKGTFTAPDSTKTTPKPPATGDAKDFPLALTPNDPGFNDLVGIAPGPRMN

SEQ ID NO: 209 - DNA, 255 bp, Trichoderma reesei
atggcgtcaacaaatgcgcgctatgtgcgctatctactaatcgccttcttcacaatcctcgtcttctactttgtctccaattcaaagtatgagggcgtcgatctcaacaagggcaccttcacagctccggattcgaccaagacgacaccaaagccgccagccactggcgatgccaaagactttcctctggccctgacgccgaacgatccaggcttcaacgacctcgtcggcatcgctcccggccctcgaatgaac

SEQ ID NO: 210 - protein, 10 aa, Artificial
  targeting signal
MASTNARYVR

SEQ ID NO: 211 - protein, 17 aa, Trichoderma reesei
YLLIAFFTILVFYFVSN

SEQ ID NO: 212 - protein, 379 aa, Trichoderma reesei
SKYEGVDLNKGTFTAPDSTKTTPKPPATGDAKDFPLALTPNDPGFNDLVGIAPGPRMNATFVTLARNSDVWDIARSIRQVEDRFNRRYNYDWVFLNDKPFDNTFKKVTTSLVSGKTHYGEIAPEHWSFPDWIDQDKAKKVREDMAERKIIYGDSVSYRHMCRFESGFFFRQPLMMNYEYYWRVEPSIELYCDIHYDPFRLMVEQGKKYSFVISLYEYPATIATLWESTKKFMKNHPEHIAPDNSMRFLSDDGGETYNNCHFWSNFEIGSLEWLRSKQYIDFFESLDKDGGFFYERWGDAPVHSIAAGLMLNRSEIHFFNDIAYWHVPFTHCPTGEKTRLDLKCHCDPKENFDWKGYSCTSRFFEMNGMDKPEGWENQQD

SEQ ID NO: 213 - protein, 8 aa, Trichoderma reesei
MAIARPVR

SEQ ID NO: 214 - protein, 15 aa, Trichoderma reesei
ALGGLAAILWCFFLY

SEQ ID NO: 215 - protein, 371 aa, Trichoderma reesei
QLLRPSSSYNSPGDRYINFERDPNLDPTGEPEGILVRTSDRYAPDAKDTDRASATLLALVRNEEVDDMVASMVDLERTWNSKFNYPWTFFNDKPFSEEFKKKTSAVTNATCNYELIPKEHWDAPSWIDPAIFEESAAVLKKNGVQYANMMSYHQMCRWNSGMFYKHPALKDVRYYWRVEPKVHFFCDVDYDVFRYMQDNNKTYGFTINLYDDPHTLPTLWPQTAKFLADHPNYLHEHSAIKWVIDDARRPQHNREAQGFSTCHFWSNFEVADMEFWRSKVYEDYFEHLDRAGGFFYERWGDAPVHSIALGLFEDSSKIHWFRDIGYQHIPFFNCPNSPKCKGCVTGRLTDGEPFLHREDCRPNWFKYAGMG

SEQ ID NO: 216 - protein, 6 aa, Trichoderma reesei
MLNPRR

SEQ ID NO: 217 - protein, 15 aa, Trichoderma reesei
ALIAAAFILTVFFLI

SEQ ID NO: 218 - protein, 352 aa, Trichoderma reesei
SRSHNSESASTSEPKDAEAEALSAANAQQRAAPPPPPQKPMIDMSGMSTYDKLAYAYEYDIESKFPAYIWQTWRKTPSEGDFEFREQEASWSIEHPGFIHEVITDSVADTLLQLLYGSIPEVLEAYHALPLPVLKADLFRYLILYARGGIYSDIDTYAIRSALEWIPPQIPKETVGLVIGIEADPDRPDWADWYSRRIQFCQWTIQSKPGHPVLRDIISRITNQTLEMKKSGKLSAFQGNRVVDLTGPAVWTDTIMDYFNDERYFDMENSKGRIDYRNFTGMETSKRVGDVVVLPITSFSPGVGQMGAKDYDDPMAFVKHDFEGTWKPESERHIGEIVQELGEGQGEAPKEQ

SEQ ID NO: 219 - protein, 22 aa, Trichoderma reesei
MGMGQCQWSPFRNKVPTQMRRC

SEQ ID NO: 220 - protein, 15 aa, Trichoderma reesei
LPLYITVVCVFLVIV

SEQ ID NO: 221 - protein, 362 aa, Trichoderma reesei
NFDWILAIPNPASVLRREPKAPPLPGSTFPQKIWQTWKVDPLNFDERDLVTARTWTTINPGMRYEVVTDANEMAYIEDRYGPNGFDRPDIVEFYKMINLPIIKADLLRYMIMYAEGGIYADIDVETMKPFHRFIPDRYDEKDIDIIIGVEIDQPDFKDHPILGKKSMSFCQWTFVARPQQPVMMRLIENIMKWFKTVARDQGVPLGEVQLDFDQVISGTGPSAFTKAMLEEMNRKTKGPKVTWDAFHNLDESKLVGGVLVLTVEAFCAGQGHSDSGNHNARNALVKHHFHASNWPSRHPRYKHPAYGQVEDCNWVPECVRKWDEDTSNWDKYSENEQKKILQDIENARLERERQQQALAALP

SEQ ID NO: 222 - protein, 17 aa, Trichoderma reesei
MARPMGSVRLKKANPST

SEQ ID NO: 223 - protein, 16 aa, Trichoderma reesei
LILGAVLCIFIIIFLV

SEQ ID NO: 224 - protein, 339 aa, Trichoderma reesei
SPSSPASASRLSIVSAQHHLSPPTSPYQSPRSGAVQGPPPVTRYNLNKVTVTSDPVRNQEHILILTPMARFYQEYWDNLLRLNYPHELITLGFILPKTKEGNQATSMLQKQIQKTQNYGPEKDRFKSIIILRQDFDPAVVSQDESERHKLANQKARREVMAKARNSLLFTTLGPSTSWVLWLDADITETAPTLIQDLASHDKPIIVANCFQKYYDPESKKMAERPYDFNSWQDSETALKMAEQMGPDDILLEGYAEMATYRTLLAYMSTPGGSKDLVVPLDGVGGTALLVKADVHRDGAMFPPFAFYHLIESEGFAKMAKRLGWQPYGLPNYKVYHYNE

SEQ ID NO: 225 - protein, 31 aa, Trichoderma reesei
MLLPKGGLDWRSARAQIPPTRALWNAVTRTR

SEQ ID NO: 226 - protein, 15 aa, Trichoderma reesei
FILLVGITGLILLLW

SEQ ID NO: 227 - protein, 358 aa, Trichoderma reesei
RGVSTSASEMQSFYCWGPAKPPMEMSPNEHNRWNGHLQTPVIFNHHAPVEVNSSTIEHVDLNPINSTKQAVTKEERILILTPLKDAAPYLSKYFELLAELTYPHRLIDLAFLVSDSTDDTLAVLASELDRIQKRPDQIPFHSATVIEKDFGFKLSQNVEERHSFEAQGPRRKAMGRARNYLLYTALKPEHSWVYWRDVDIVDSPTGILEDFIAHDRDILVPNIWFHRYRDGVDIEGRFDYNSWVESDKGRKLANSLDKDVVLAEGYKQYDTGRTYMAKMGDWRENKDVELELDGIGGVNILVKADVHRSGINFPCYAFENQAETEGFAKMAKRAGYEVYGLPNYVVWHIDTEEKGGNA

SEQ ID NO: 228 - protein, 45 aa, Trichoderma reesei
MMPRHHSSGFSNGYPRADTFEISPHRFQPRATLPPHRKRKRTAIR

SEQ ID NO: 229 - protein, 16 aa, Trichoderma reesei
VGIAVVVILVLVLWFG

SEQ ID NO: 230 - protein, 407 aa, Trichoderma reesei
QPRSVASLISLGILSGYDDLKLETVRYYDLSNVQGTARGWEREERILLCVPLRDAEQHLPMFFSHLKNFTYPHNLIDLAFLVSDSKDHTLESLTEHLEAIQADPDPKQPYGEISIIEKDFGQKVNQDVESRHGFAAQASRRKLMAQARNWLLSAALRPYHSWVYWRDVDVETAPFTILEDLMRHNKDVIVPNVWRPLPDWLGGEQPYDLNSWQESETALALADTLDEDAVIVEGYAEYATWRPHLAYLRDPYGDPDMEMEIDGVGGVSILAKAKVFRAGVHFPAFSFEKHAETEGFGKMAKRMHFSVVGLPHYTIWHLYEPSVDDIKHMEEMERERIAREKEEEERKKKEAQIKEEFGDANSQWEQDKQQMQDLKLQDRGGDKEAAAAGVNQGAAAKAAGAMEGQKN

SEQ ID NO: 231 - protein, 119 aa, Trichoderma reesei
MSLSRSPSPVPGGGWSSPGLNINSGRSSPSNAAGSSVSWESAKMRKQGANGYPSFSTQNQGFFTRHMRRISSSLPRFAAGPGNTYAEREKYERGGHSPHAGGGRLRAFLARIGRRLKWR

SEQ ID NO: 232 - protein, 15 aa, Trichoderma reesei
ILLPLIIICTIVAYY

SEQ ID NO: 233 - protein, 325 aa, Trichoderma reesei
GTHEAPGFVHWWRRISMGGGGEKFVIILGANVGGGVMEWKGAREWAIERDSVRNKRKYATRWGYDLEIVDMKTKKRYAHEWRESWEKVDFIRAAMRKYPKAEWFWWLDLNTYVMEPSYSLQRHLFNHLDRHVYRDINVFNPLNITHPPTEEYLDAEARSPVGDGNINSVNLMLTQDCSGFNLGSFFIRRSAWTEQLLDIWWDPVLYEQKHMEWEHKEQDALEQLYRTQPWIRQHTGFLPQRLINSFPPAACADESGLNNTRIHYNEKDRDFVVNMAGCEWGRDCWGEMYHYREFSYWLNRNPWELFKEEIVAVIWYKLTGQRVKL

SEQ ID NO: 234 - protein, 33 aa, Trichoderma reesei
MHFAYPSRKSSNPPPFRPRSTRLPGLRRSRIKT

SEQ ID NO: 235 - protein, 15 aa, Trichoderma reesei
IGIVLFLVLATLWFF

SEQ ID NO: 236 - protein, 262 aa, Trichoderma reesei
SNPRVPRPDPERVPSGRPPVVLVTVIDPTQYPNAYLKTIKENREQYAAKHGYEAFIVKAYDYDTQGAPQSWSKLMAMRHALTKFPECRFVWYLDQDAYIMDMSKSLEEQLLNRQKLESLMIKNYPVVPPDSIIKTFSHLRPDEVDLIVSQDSSGLVAGSVVVRNSQWSKFLLETWMDPLYRSYNFQKAERHALEHIVQWHPTILSKLALVPQRTLGPYTRTDQGDAYQDGDFVVMFTGCTKSGEQSCETVSASYYQKWSSSL

SEQ ID NO: 237 - protein, 90 aa, Trichoderma reesei
MIRDPFGIHSKNAFKATALRAARDIKEAATQAGANALEMSFSLPKHVPDFGDPSRALEDRAWAALLPMYKDKPYAYAPSMRLRPWWRRRK

SEQ ID NO: 238 - protein, 19 aa, Trichoderma reesei
VLGMIAAAVMFVLYVTGFF

SEQ ID NO: 239 - protein, 565 aa, Trichoderma reesei
SSGQTEEAKKKASGSAFSWLGLSQERGGVDWDERRKSVVEAFEVWDAYERYAWGKDEFHPISKNGRNMAPKGLGWIIIDSLDTMMLMNQTTRLQHAREWISTSLTWDQDQDVNTFETTIRMLGGLLSAHYLSTEFPELAPLTEDDEGAPGEDLYLEKAKDLADRLLSAFESESGIPYASVNIGEYKGPSHSDNGASSTAEATTLQLEFKYLAKLTGEKNFWDKVEKVMEVVDDNQPEDGLVPIYIYATTGEFRGQNIRLGSRGDSYYEYLIKQYLQTNKQEPIYEEMWDEALAGVRKHLVTYTEPSEFTIIAERPDGLEHPMSPKMDHLVCFMPGTIALAATGGLTEAEARKLSTWNKKKDDDMQLARELMHTCWGMYKYMKTGLAPEIMYFNIPNPPPESSAPHQAPAAFDEDPHAEWRKDFVVHSNDVHNLQRPETVESLFYMWRITGDVKYREWGWDMFKSFVNYTAVEDQGGFTSLLDANSIPPTPKDNMESFWLAETLKYMYLLFSPNDVLPLHKIVLNTEAHPFPRFDMGPLFSTGWKRKPRDGSAKKKATTAATTDAE

SEQ ID NO: 240 - protein, 7 aa, Trichoderma reesei
MARRRYR

SEQ ID NO: 241 - protein, 15 aa, Trichoderma reesei
LFMICAAVILFLLYR

SEQ ID NO: 242 - protein, 871 aa, Trichoderma reesei
VSQNTWDDSAHYATLRHPPASNPPAAGGESPLKPAAKPEHEHEHENGYAPESKPKPQSEPKPESKPAPEHAAGGQKSQGKPSYEDDEETGKNPPKSAVIPSDTRLPPDNKVHWRPVKEHFPVPSESVISLPTGKPLKVPRVQHEFGVESPEAKSRRVARQERVGKEIERAWSGYKKFAWMHDELSPVSAKHRDPFCGWAATLVDSLDTLWIAGLKEQFDEAARAVEQIDFTTTPRNNIPVFETTIRYLGGLLGAFDVSGGHDGGYPMLLTKAVELAEILMGIFDTPNRMPILYYQWQPEYASQPHRAGSVGIAELGTLSMEFTRLAQLTSQYKYYDAVDRITDALIELQKQGTSIPGLFPENLDASGCNHTATALRSSLSEAAQKQMDEDLSNKPENYRPGKNSKADPQTVEKQPAKKQNEPVEKAKQVPTQQTAKRGKPPFGANGFTANWDCVPQGLVVGGYGFQQYHMGGGQDSAYEYFPKEYLLLGGLESKYQKLYVDAVEAINEWLLYRPMTDGDWDILFPAKVSTAGNPSQDLVATFEVTHLTCFIGGMYGLGGKIFGREKDLETAKRLTDGCVWAYQSTVSGIMPEGSQVLACPTLEKCDFNETLWWEKLDPAKDWRDKQVADDKDKATVGEALKETANSHDAAGGSKAVHKRAAVPLPKPGADDDVGSELPQSLKDKIGFKNGEQKKPTGSSVGIQRDPDAPVDSVLEAHRLPPQEPEEQQVILPDKPQTHEEFVKQRIAEMGFAPGVVHIQSRQYILRPEAIESVWYMYRITGDPIWMEKGWKMFEATIRATRTEIANSAIDDVNSEEPGLKDEMESFWLAETLKYYYLLFSEPSVISLDEWVLNTEAHPFKRPGGSVIGHSI

SEQ ID NO: 243 - protein, 13 aa, Trichoderma reesei
MLNQLQGRVPRRY

SEQ ID NO: 244 - protein, 15 aa, Trichoderma reesei
IALVAFAFFVAFLLW

SEQ ID NO: 245 - protein, 542 aa, Trichoderma reesei
SGYDFVPRTATVGRFKYVPSSYDWSKAKVYYPVKDMKTLPQGTPVTFPRLQLRNQSEAQDDTTKARKQAVKDAFVKSWEAYKTYAWTKDQLQPLSLSGKETFSGWSAQLVDALDTLWIMDLKDDFFLAVKEVAVIDWSKTKDNKVINLFEVTIRYLGGLIAAYDLSQEPVLRAKAIELGDTLYATFDTPNRLPSHWLDYSKAKKGTQRADDSMSGAAGGTLCMEFTRLSQITGDPKYYDATERIKQFFYRFQNETTLPGMWPVMMNYREETMVESRYSMGGSADSLYEYLVKMPALLGGLDPQYPEMAIRALDTARDNLLFRPMTEKGDNILALGNALVDHGNVQRITEMQHLTCFAGGMYAMAGKLFKRDDYVDLGSRISSGCVWAYDSFPSGIMPESADMAACAKLDGPCPYDEVKAPVDPDGRRPHGFIHVKSRHYLLRPEAIESVFYMWRITGDQVWRDTAWRMWENIVREAETEHAFAIVEDVTRTASKLTNNYLLQTFWLAETLKYFYLIFDDESAIDLDKWVFNTEAHPFKRPAV

SEQ ID NO: 246 - protein, 13 aa, Trichoderma reesei
MLVVGRPRLVRNS

SEQ ID NO: 247 - protein, 16 aa, Trichoderma reesei
IILTLAILSIWHLGLL

SEQ ID NO: 248 - protein, 576 aa, Trichoderma reesei
SRTPTSASALVSASVSASSEWSRLERLMNRGAPLTPYPDSNSSFDWSAIPFRYPPHNTTHLPPRHKQPPLPRIQHRFGPESPAAAKERIKRLKAVKQVFLRAWQAYKGYAWKQDALLPISGGGREQFSGWAATLVDALDTLWIMGLREEFDEAVAAVAEIDFGSSTSSRVNIFETNIRYLGGLLAAYDLSGREVLLKKAVELGDLIYAGFNTENGMPVDFLNFYSAKSGEGLVVESSVVSASPGTLSLELAHLSQVTGDDKYYSAVSQVMDVFYQGQNKTRLPGVWPIDVNMRAKDVVSGSRFTLGGCADSLYEYLPKMHQLLGGGEPKYETMSRTFLQAADRHFVFRPMLPGAEEDVLMPGNVNVDEDSGEAVLDPETEHLACFVGGMFGLAGRLFSRPDDVETGVRLTNGCVYAYRAFPTGMMPERLDLAPCRDRSSRCPWDEEHWLEERAKRPEWEPHLPRGFTSAKDPRYLLRPEAIESVFYSYRITGRQEFQTAAWDMFTAVEKGTRTQFANAAVLDVTRAADELPQEDYMESFWLAETLKYFYLMFTTPDIISLDDYVLNTEAHPFKLVG

SEQ ID NO: 249 - protein, 17 aa, Trichoderma reesei
MVMLVAIALAWLGCSLL

SEQ ID NO: 250 - protein, 1053 aa, Trichoderma reesei
RPVDAMRADYLAQLRQETVDMFYHGYSNYMEHAFPEDELRPISCTPLTRDRDNPGRISLNDALGNYSLTLIDSLSTLAILAGGPQNGPYTGPQALSDFQDGVAEFVRHYGDGRSGPSGAGIRARGFDLDSKVQVFETVIRGVGGLLSAHLFAIGELPITGYVPRPEGVAGDDPLELAPIPWPNGFRYDGQLLRLALDLSERLLPAFYTPTGIPYPRVNLRSGIPFYVNSPLHQNLGEAVEEQSGRPEITETCSAGAGSLVLEFTVLSRLTGDARFEQAAKRAFWEVWHRRSEIGLIGNGIDAERGLWIGPHAGIGAGMDSFFEYALKSHILLSGLGMPNASTSRRQSTTSWLDPNSLHPPLPPEMHTSDAFLQAWHQAHASVKRYLYTDRSHFPYYSNNHRATGQPYAMWIDSLGAFYPGLLALAGEVEEAIEANLVYTALWTRYSALPERWSVREGNVEAGIGWWPGRPEFIESTYHIYRATRDPWYLHVGEMVLRDIRRRCYAECGWAGLQDVQTGEKQDRMESFFLGETAKYMYLLFDPDHPLNKLDAAYVFTTEGHPLIIPKSKRGSGSHNRQDRARKAKKSRDVAVYTYYDESFTNSCPAPRPPSEHHLIGSATAARPDLFSVSRFTDLYRTPNVHGPLEKVEMRDKKKGRVVRYRATSNHTIFPWTLPPAMLPENGTCAAPPERIISLIEFPANDITSGITSRFGNHLSWQTHLGPTVNILEGLRLQLEQVSDPATGEDKWRITHIGNTQLGRHETVFFHAEHVRHLKDEVFSCRRRRDAVEIELLVDKPSDTNNNNTLASSDDDVVVDAKAEEQDGMLADDDGDTLNAETLSSNSLFQSLLRAVSSVFEPVYTAIPESDPSAGTAKVYSFDAYTSTGPGAYPMPSISDTPIPGNPFYNFRNPASNFPWSTVFLAGQACEGPLPASAPREHQVIVMLRGGCSFSRKLDNIPSFSPHDRALQLVVVLDEPPPPPPPPPANDRRDVTRPLLDTEQTTPKGMKRLHGIPMVLVRAARGDYELFGHAIGVGMRRKYRVESQGLVVENAVVL

SEQ ID NO: 251 - protein, 45 aa, Trichoderma reesei; identical to SEQ ID NO: 228

SEQ ID NO: 252 - protein, 16 aa, Trichoderma reesei
VGIAVVVILVLVLWFG

SEQ ID NO: 253 - protein, 405 aa, Trichoderma reesei
QPRSVASLISLGILSGYDDLKLETVRYYDLSNVQGTARGWEREERILLCVPLRDAEQHLPMFFSHLKNFTYPHNLIDLAFLVSDSKDHTLESLTEHLEAIQADPDPKQPYGEISIIEKDFGQKVNQDVESRHGFAAQASRRKLMAQARNWLLSAALRPYHSWVYWRDVDVETAPFTILEDLMRHNKDVIVPNVWRPLPDWLGGEQPYDLNSWQESETALALADTLDEDAVIVEGYAEYATWRPHLAYLRDPYGDPDMEMEIDGVGGVSILAKAKVFRAGVHFPAFSFEKHAETEGFGKMAKRMHFSVVGLPHYTIWHLYEPSVDDIKHMEEMERERIAREKEEEERKKKEAQIKEEFGDANSQWEQDKQQMQDLKLQDRGGDKEAAAAGVNQGAAAKAAGAMEGQ

SEQ ID NO: 254 - protein, 31 aa, Trichoderma reesei; identical to SEQ ID NO: 225

SEQ ID NO: 255 - protein, 15 aa, Trichoderma reesei
FILLVGITGLILLLW

SEQ ID NO: 256 - protein, 358 aa, Trichoderma reesei; identical to SEQ ID NO: 227

SEQ ID NO: 257 - protein, 17 aa, Trichoderma reesei
MARPMGSVRLKKANPST

SEQ ID NO: 258 - protein, 16 aa, Trichoderma reesei
LILGAVLCIFIIIFLV

SEQ ID NO: 259 - protein, 339 aa, Trichoderma reesei; identical to SEQ ID NO: 224

SEQ ID NO: 260 - protein, 33 aa, Trichoderma reesei; identical to SEQ ID NO: 234

SEQ ID NO: 261 - protein, 15 aa, Trichoderma reesei
IGIVLFLVLATLWFF

SEQ ID NO: 262 - protein, 262 aa, Trichoderma reesei; identical to SEQ ID NO: 236

SEQ ID NO: 263 - protein, 119 aa, Trichoderma reesei; identical to SEQ ID NO: 231

SEQ ID NO: 264 - protein, 16 aa, Trichoderma reesei
ILLPLIIICTIVAYYG

SEQ ID NO: 265 - protein, 324 aa, Trichoderma reesei
THEAPGFVHWWRRISMGGGGEKFVIILGANVGGGVMEWKGAREWAIERDSVRNKRKYATRWGYDLEIVDMKTKKRYAHEWRESWEKVDFIRAAMRKYPKAEWFWWLDLNTYVMEPSYSLQRHLFNHLDRHVYRDINVFNPLNITHPPTEEYLDAEARSPVGDGNINSVNLMLTQDCSGFNLGSFFIRRSAWTEQLLDIWWDPVLYEQKHMEWEHKEQDALEQLYRTQPWIRQHTGFLPQRLINSFPPAACADESGLNNTRIHYNEKDRDFVVNMAGCEWGRDCWGEMYHYREFSYWLNRNPWELFKEEIVAVIWYKLTGQRVKL

SEQ ID NO: 266 - DNA, 40 bp, Trichoderma reesei
agctccgtggcgaaagcctgacgcaccggtagattcttgg

SEQ ID NO: 267 - DNA, 1000 bp, Trichoderma reesei
gttgggctgaggccgtatcggagggacggggtgaggattgaggcggaggagatgaagggggatgatggggagacggtggttgttgtgcataattatgggcatgcgggatgggggtatcaggggtcgtatgggtgtgcggagagggttgtcgagttggtggaggggattgtgaggggatgagcggatgtttttgatgttttgactgctcgcctttgactcgattctgatacggacacttttcgacctttgtttctccaagatggccctgtacagtcagattgatagaggagcatgtataattcattgccggttgccgtcccgtttccaagcagaaagccactgttgagaagcaacgtgctttgacgaaagtcgtggctcactactcaaatctctccacactcatacattgtgtttcagtcaaaacactttggcaaccaagacgtgggagggagtatctgcatcttttctcatcggcaagctatctgactcgattgagaagatgcgtggttcatatcacctggccgttggaggtttcttcctaggcagtcgctctgttctccttctataaagaactccatcgttcttgaatacctctttggccttcaagctcgatagtattgaacccattcttcactcatgctgctcatcattccacctccctcaagttgggtgtcgttgagtacctagtgtacataagcgggtctatgcatttaaaggggtatcttcaccaccagcaatatccacacttctaggctccacgttgcacataacgaaaccaaaacagctaaaccgacgggccaatttcacgcgcatcttcatcgacgaagcgagcgacagcgaagccgatacgcaaatcctcttcagacaagctcaactcggccaagcctcatgttttgccaacggaaccctgcacaagtcggctggcattaaagaggaaaggagaacagaaagagagtgagcagatttcagtctctcaccactcacctgagttgcctctctc

SEQ ID NO: 268 - DNA, 1001 bp, Trichoderma reesei
gggcagtatgccggatggctggcttatacaggcaaaaaccaccttcttcattcttcattcttcgtcttcttcttcttcttcctcctcatcgtcggtaggcggcagctttcccacattggagtcgctctcctcgtcgctgagttcctcgaccgtcttttcgaattcctttggcctggagtcatcataatagtttaatacacgtttagagtatagagagaaaaaataagggggaaaaagacgcaaatcataccagtacggctgcttccgccagagcttctcgtcgcgcacgaccttgataatctcgccaaaggccctgctgtcctgcgtgccgacgggatatccctcggccaggacgtagccgccgcgcttgatccagacggtgttgcgcaggcgctgggcgagctcgaggacgacgtgcttcttgctgggcatctcgcaggtgtagaggttgttgccctcgggcttcaggacgcgcacaatggcctgcgtcggctcgagggcatcgggaggcgtgagggcctcttgtgtggcggcaaggacatttcgcttcggcttacccatggctgcgagtctttggggtcgattcggtgatactatctgatcccaagaaaaaagagacaaaatttcattgttgttgattggaaaataaactggggccgtgatggaggggcagctttatcgataggacggggatttctcgaataggaaaataaaacccctccgcccgtcccgctctccggcacggtgttgccccattcggcgaaaccgcttcagggaccaaactagaagtaaggtacctatccataagctatcacgatgatatagaaggcatggatgtattgcaaaagcgaattgttagacgccccaatgggaggcttggtggggttatcggtttacgaaatacttgaatcaatgcattattaatctatccattaggcattttggcgttcaccagaccgtttgactcaccgatatcgttcgtggtggtactcggccagatg

SEQ ID NO: 269 - DNA, 63 bp, Artificial Sequence
  PRIMER
agatttcagtctctcaccactcacctgagttgcctctctcggtctgaaggacgtggaatgatg

SEQ ID NO: 270 - DNA, 66 bp, Artificial Sequence
  PRIMER
cagagccgctatcgccgaggaggttgcccttcttgcccatgttgagagaagttgttggattgatca

SEQ ID NO: 271 - DNA, 21 bp, Artificial Sequence
  PRIMER
agctccgtggcgaaagcctga

SEQ ID NO: 272 - DNA, 66 bp, Artificial Sequence
  PRIMER
cagccgcagcctcagcctctctcagcctcatcagccgcggccgccaactttgcgtcccttgtgacg

SEQ ID NO: 273 - DNA, 76 bp, Artificial Sequence
  PRIMER
gcaacgagagcagagcagcagtagtcgatgctaggcggccgcgggcagtatgccggatggctggcttatacaggca

SEQ ID NO: 274 - DNA, 76 bp, Artificial Sequence
  PRIMER
tgcctgtataagccagccatccggcatactgcccgcggccgcctagcatcgactactgctgctctgctctcgttgc

SEQ ID NO: 275 - DNA, 20 bp, Artificial Sequence
  PRIMER
tgcgtcgccgtctcgctcct

SEQ ID NO: 276 - DNA, 20 bp, Artificial Sequence
  PRIMER
ttaggcgacctctttttcca

SEQ ID NO: 277 - DNA, 20 bp, Artificial Sequence
  PRIMER
cgaggaagtctcgtgaggat

SEQ ID NO: 278 - DNA, 19 bp, Artificial Sequence
  PRIMER
cagctaaaccgacgggcca

SEQ ID NO: 279 - DNA, 20 bp, Artificial Sequence
  PRIMER
gaccgtatatttgaaaaggg

SEQ ID NO: 280 - DNA, 20 bp, Artificial Sequence
  PRIMER
gatgttgcgcctgggttgac

SEQ ID NO: 281 - DNA, 23 bp, Artificial Sequence
  PRIMER
taacttgtacgctctcagttcga

SEQ ID NO: 282 - DNA, 20 bp, Artificial Sequence
  PRIMER
ccatgagcttgaacaggtaa

SEQ ID NO: 283 - DNA, 20 bp, Artificial Sequence
  PRIMER
gattgtcatggtgtacgtga

SEQ ID NO: 284 - DNA, 20 bp, Artificial Sequence
  PRIMER
caagatggagggcggcacag

SEQ ID NO: 285 - DNA, 22 bp, Artificial Sequence
  PRIMER
gccagtagcgtgatagagaagc

SEQ ID NO: 286 - DNA, 20 bp, Artificial Sequence
  PRIMER
gcgtcactcatcaaaactgc

SEQ ID NO: 287 - DNA, 19 bp, Artificial Sequence
  PRIMER
cttcggcttcgatgtttca

SEQ ID NO: 288 - DNA, 69 bp, Artificial Sequence
  PRIMER
cgattaagttgggtaacgccagggttttcccagtcacgacggtttaaacgctgcagggcgtacagaact

SEQ ID NO: 289 - DNA, 69 bp, Artificial Sequence
  PRIMER
atctctcaaaggaagaatcccttcagggttgcgtttccagtgcggccgcggctctaaaatgcttcacag

SEQ ID NO: 290 - DNA, 68 bp, Artificial Sequence
  PRIMER
cggttctcatctgggcttgctcggtcctggcgtagatctagcggccgcacgatgatgatgacagccag

SEQ ID NO: 291 - DNA, 69 bp, Artificial Sequence
  PRIMER
gtggaattgtgagcggataacaatttcacacaggaaacagcgtttaaaccgtccagctcccgcagcgcc

SEQ ID NO: 292 - DNA, 84 bp, Artificial Sequence
  PRIMER
atcgctaactgctttctcttctgtgaagcattttagagccgcggccgcggccggccgcgatcgcctagatctacgccaggaccg

SEQ ID NO: 293 - DNA, 48 bp, Artificial Sequence
  PRIMER
cggtcctggcgtagatctagggcgcgccactggaaacgcaaccctgaa

SEQ ID NO: 294 - DNA, 48 bp, Artificial Sequence
  PRIMER
ttcagggttgcgtttccagtggcgcgccctagatctacgccaggaccg

SEQ ID NO: 295 - DNA, 68 bp, Artificial Sequence
  PRIMER
agcatcatgaccgcccccttctggctgtcatcatcatcgtgcggccgcgattattgcacaagcagcga

SEQ ID NO: 296 - DNA, 20 bp, Artificial Sequence
  PRIMER
tatggctttagatggggaca

SEQ ID NO: 297 - DNA, 20 bp, Artificial Sequence
  PRIMER
tgcgtcgccgtctcgctcct

SEQ ID NO: 298 - DNA, 20 bp, Artificial Sequence
  PRIMER
ttaggcgacctctttttcca

SEQ ID NO: 299 - DNA, 18 bp, Artificial Sequence
  PRIMER
cctgtatcgtcctgttcc

SEQ ID NO: 300 - DNA, 20 bp, Artificial Sequence
  PRIMER
gcgcctgtcgagtcggcatt

SEQ ID NO: 301 - DNA, 20 bp, Artificial Sequence
  PRIMER
caccggccatgctcttgcca

SEQ ID NO: 302 - DNA, 18 bp, Artificial Sequence
  PRIMER
caaggtgccctatgtcgc

SEQ ID NO: 303 - DNA, 18 bp, Artificial Sequence
  PRIMER
gatcgggtcaggacggaa

SEQ ID NO: 304 - DNA, 18 bp, Artificial Sequence
  PRIMER
agcctgtctgagggacgg

SEQ ID NO: 305 - DNA, 18 bp, Artificial Sequence
  PRIMER
caaggtcgagattcggca

SEQ ID NO: 306 - DNA, 17 bp, Artificial Sequence
  PRIMER
cagaagggggcggtcat

SEQ ID NO: 307 - DNA, 17 bp, Artificial Sequence
  PRIMER
gtcccagctcccgctct

SEQ ID NO: 308 - DNA, 20 bp, Artificial Sequence
  PRIMER
gcgcctgtcgagtcggcatt

SEQ ID NO: 309 - DNA, 20 bp, Artificial Sequence
  PRIMER
caccggccatgctcttgcca

SEQ ID NO: 310 - DNA, 20 bp, Artificial Sequence
  PRIMER
cgtcctctattccgttcatc

SEQ ID NO: 311 - DNA, 20 bp, Artificial Sequence
  PRIMER
tccatcattccacgtccttc

SEQ ID NO: 312 - DNA, 21 bp, Artificial Sequence
  PRIMER
ggagggaagggaagaaagaag

SEQ ID NO: 313 - DNA, 19 bp, Artificial Sequence
  PRIMER
tcacccgcgagaattacac

SEQ ID NO: 314 - DNA, 22 bp, Artificial Sequence
  PRIMER
cctcgcctgattgtgtacttcc

SEQ ID NO: 315 - DNA, 20 bp, Artificial Sequence
  PRIMER
gctaggcctcttcacaaagc

SEQ ID NO: 316 - DNA, 18 bp, Artificial Sequence
  PRIMER
tggtcaagtcggtaaagc

SEQ ID NO: 317 - DNA, 19 bp, Artificial Sequence
  PRIMER
tcgcaacctgacctgaaag

SEQ ID NO: 318 - DNA, 20 bp, Artificial Sequence
  PRIMER
ataggcaaagagtataaggg

SEQ ID NO: 319 - DNA, 18 bp, Artificial Sequence
  PRIMER
tatgctcacgacttcttc

SEQ ID NO: 320 - DNA, 22 bp, Artificial Sequence
  PRIMER
cctcgcctgattgtgtacttcc

SEQ ID NO: 321 - DNA, 20 bp, Artificial Sequence
  PRIMER
gctaggcctcttcacaaagc

SEQ ID NO: 322 - DNA, 20 bp, Artificial Sequence
  PRIMER
gctgttcctacagctctttc

SEQ ID NO: 323 - DNA, 14 bp, Artificial Sequence
  PRIMER
agccgcacggcagc

SEQ ID NO: 324 - DNA, 20 bp, Artificial Sequence
  PRIMER
cctagtgaatgctccgtaac

SEQ ID NO: 325 - DNA, 19 bp, Artificial Sequence
  PRIMER
cttccacttcagggttgac

SEQ ID NO: 326 - DNA, 20 bp, Artificial Sequence
  PRIMER
acccatagggagacaaacag

SEQ ID NO: 327 - DNA, 19 bp, Artificial Sequence
  PRIMER
cttccacttcagggttgac

SEQ ID NO: 328 - DNA, 20 bp, Artificial Sequence
  PRIMER
aaacgggtaggaattgtcac

SEQ ID NO: 329 - DNA, 19 bp, Artificial Sequence
  PRIMER
gaatgagtgcctgctactg

SEQ ID NO: 330 - DNA, 19 bp, Artificial Sequence
  PRIMER
ctctggattctcggttacg

SEQ ID NO: 331 - DNA, 19 bp, Artificial Sequence
  PRIMER
cagctctccgactcttaac

SEQ ID NO: 332 - DNA, 20 bp, Artificial Sequence
  PRIMER
cctagtgaatgctccgtaac

SEQ ID NO: 333 - DNA, 18 bp, Artificial Sequence
  PRIMER
ccgcccttatactctttg

SEQ ID NO: 334 - DNA, 20 bp, Artificial Sequence
  PRIMER
gggtgagaggctaccttaac

SEQ ID NO: 335 - DNA, 20 bp, Artificial Sequence
  PRIMER
tccatcattccacgtccttc

SEQ ID NO: 336 - DNA, 21 bp, Artificial Sequence
  PRIMER
ggagggaagggaagaaagaag

SEQ ID NO: 337 - DNA, 20 bp, Artificial Sequence
  PRIMER
ctttgtcgacgacacaaagg

SEQ ID NO: 338 - DNA, 20 bp, Artificial Sequence
  PRIMER
cctcaaccctgcaatagttc

SEQ ID NO: 339 - DNA, 20 bp, Artificial Sequence
  PRIMER
gtcgcaccaagtcttgattc

SEQ ID NO: 340 - DNA, 18 bp, Artificial Sequence
  PRIMER
gggcgtacagaactgttg

SEQ ID NO: 341 - DNA, 18 bp, Artificial Sequence
  PRIMER
gtcgttgaaggctgagac

SEQ ID NO: 342 - DNA, 19 bp, Artificial Sequence
  PRIMER
gatgatgacagccagaagg

SEQ ID NO: 343 - DNA, 18 bp, Artificial Sequence
  PRIMER
ctcccgctctcgtatatg

SEQ ID NO: 344 - DNA, 20 bp, Artificial Sequence
  PRIMER
caacaactactggcagatcc

SEQ ID NO: 345 - DNA, 18 bp, Artificial Sequence
  PRIMER
gacctctgcagctcaaac

SEQ ID NO: 346 - DNA, 20 bp, Trichoderma reesei
ccccaccgagggtcagaaga

SEQ ID NO: 347 - DNA, 20 bp, Trichoderma reesei
caccgtcctgtctgcctcca

SEQ ID NO: 348 - DNA, 20 bp, Trichoderma reesei
tccaggcccaggcaaagttc

SEQ ID NO: 349 - DNA, 20 bp, Trichoderma reesei
gttcaacgacaagccgccca

SEQ ID NO: 350 - DNA, 20 bp, Trichoderma reesei
gcatgccattgagatcaacc

SEQ ID NO: 351 - DNA, 20 bp, Trichoderma reesei
ccacgcgcggcgccccaagc

SEQ ID NO: 352 - DNA, 20 bp, Trichoderma reesei
attacgttgcagctcgacac

SEQ ID NO: 353 - DNA, 20 bp, Trichoderma reesei
caccacctttgtcgacgcca

SEQ ID NO: 354 - DNA, 20 bp, Trichoderma reesei
gacgccatcaataacctcac

SEQ ID NO: 355 - DNA, 20 bp, Trichoderma reesei
cccgatgcgcccaacaccgc

SEQ ID NO: 356 - DNA, 20 bp, Trichoderma reesei
tcgcagatccgcgtccgcgc

SEQ ID NO: 357 - DNA, 20 bp, Trichoderma reesei
atctatctaagcatttcgca

SEQ ID NO: 358 - DNA, 20 bp, Trichoderma reesei
gctgcccctgatgcgactat

SEQ ID NO: 359 - DNA, 20 bp, Trichoderma reesei
gtcgaccaactccatactca

SEQ ID NO: 360 - DNA, 20 bp, Trichoderma reesei
aacgacaccgacatcttcta

SEQ ID NO: 361 - DNA, 20 bp, Trichoderma reesei
cgcgtacatcttcgaattcg

SEQ ID NO: 362 - DNA, 20 bp, Trichoderma reesei
ctgaagcacactttcaagat

SEQ ID NO: 363 - DNA, 20 bp, Trichoderma reesei
cttgttcccactaccaagca

SEQ ID NO: 364 - DNA, 20 bp, Trichoderma reesei
actccttcagcatgcacacc

SEQ ID NO: 365 - DNA, 20 bp, Trichoderma reesei
agaaaccgttaagcagatca

SEQ ID NO: 366 - DNA, 20 bp, Trichoderma reesei
aacaagaacagcacgttcga

SEQ ID NO: 367 - DNA, 20 bp, Trichoderma reesei
gtgatggcacctacgatgcc

SEQ ID NO: 368 - DNA, 20 bp, Trichoderma reesei
gtgctgcccgccgctccaac

SEQ ID NO: 369 - DNA, 20 bp, Trichoderma reesei
gtcattgattcgcccccaga

SEQ ID NO: 370 - DNA, 20 bp, Trichoderma reesei
cgcgaattcccctcagactc

SEQ ID NO: 371 - DNA, 20 bp, Trichoderma reesei
gagcttctacaagttcgcaa

SEQ ID NO: 372 - DNA, 20 bp, Trichoderma reesei
cctcgactcgcgcttcgtca

SEQ ID NO: 373 - DNA, 20 bp, Trichoderma reesei
gcagccagcactcccaccta

SEQ ID NO: 374 - DNA, 20 bp, Trichoderma reesei
tctccgacccctcaagccca

SEQ ID NO: 375 - DNA, 20 bp, Trichoderma reesei
gcagttctgccgtcgagtct

SEQ ID NO: 376 - DNA, 20 bp, Trichoderma reesei
gagataccagcaacgcgcga

SEQ ID NO: 377 - DNA, 20 bp, Trichoderma reesei
gatccttcatcagaaacatt

SEQ ID NO: 378 - DNA, 20 bp, Trichoderma reesei
gcagccatatatcgacagcc

SEQ ID NO: 379 - DNA, 20 bp, Trichoderma reesei
cagacgacgacgctcaagaa

SEQ ID NO: 380 - DNA, 20 bp, Trichoderma reesei
tgtgctcctgaccgacaagc

SEQ ID NO: 381 - DNA, 20 bp, Trichoderma reesei
gcacaagcttgccctgacgc

SEQ ID NO: 382 - DNA, 20 bp, Trichoderma reesei
ccaagaagaacagctcgtac

SEQ ID NO: 383 - DNA, 20 bp, Trichoderma reesei
agccgtgccctcgttcatcc

SEQ ID NO: 384 - DNA, 20 bp, Trichoderma reesei
actgccgtggacattgccaa

SEQ ID NO: 385 - DNA, 20 bp, Trichoderma reesei
ccaagttccccgcctacatc

SEQ ID NO: 386 - DNA, 20 bp, Trichoderma reesei
tgctcgttccacatcaacca

SEQ ID NO: 387 - DNA, 20 bp, Trichoderma reesei
tttgctacgccctccaccgt

SEQ ID NO: 388 - DNA, 20 bp, Trichoderma reesei
cagtcaccagcaagacaaag

SEQ ID NO: 389 - DNA, 20 bp, Trichoderma reesei
cgacctccacgatgtcatca

SEQ ID NO: 390 - DNA, 20 bp, Trichoderma reesei
aagacgaagctccgccaatc

SEQ ID NO: 391 - DNA, 20 bp, Trichoderma reesei
aagagcacgaccgtttcgtc

SEQ ID NO: 392 - DNA, 20 bp, Trichoderma reesei
tctgacgctgctcctcgcga

SEQ ID NO: 393 - DNA, 20 bp, Trichoderma reesei
atcaccgacacgcgagacct

SEQ ID NO: 394 - DNA, 20 bp, Trichoderma reesei
gtcgctggcctcgtccctca

SEQ ID NO: 395 - DNA, 20 bp, Trichoderma reesei
gagctcgtccgacccccgcc

SEQ ID NO: 396 - DNA, 20 bp, Trichoderma reesei
ccctgtccctgaccttacaa

SEQ ID NO: 397 - DNA, 20 bp, Trichoderma reesei
gaaatcacaacactgccaaa

SEQ ID NO: 398 - DNA, 20 bp, Trichoderma reesei
gaactcaacctccaagacgc

SEQ ID NO: 399 - DNA, 20 bp, Trichoderma reesei
gagtatgttgccatgttcct

SEQ ID NO: 400 - DNA, 20 bp, Trichoderma reesei
gctcttcttgtccagcactt

SEQ ID NO: 401 - DNA, 20 bp, Trichoderma reesei
cacggagactgctgccgctc

SEQ ID NO: 402 - DNA, 20 bp, Trichoderma reesei
ctacttcacctacgacatcc

SEQ ID NO: 403 - DNA, 20 bp, Trichoderma reesei
catcctcaccatcctcacca

SEQ ID NO: 404 - DNA, 20 bp, Trichoderma reesei
gctctcacgaaatcctcgac

SEQ ID NO: 405 - DNA, 20 bp, Trichoderma reesei
gctctctgagcctgcaagac

SEQ ID NO: 406 - DNA, 20 bp, Trichoderma reesei
gctgcgcgatctcgacttca

SEQ ID NO: 407 - DNA, 20 bp, Trichoderma reesei
ccgcgtctcctgcacgtagt

SEQ ID NO: 408 - DNA, 20 bp, Trichoderma reesei
tgcgcgaccccgtcatcgtc

SEQ ID NO: 409 - DNA, 20 bp, Trichoderma reesei
acctctctggtccacgacct

SEQ ID NO: 410 - DNA, 20 bp, Trichoderma reesei
gactcctccctccacaccgt

SEQ ID NO: 411 - DNA, 20 bp, Trichoderma reesei
tctgtcgaggagagcaacat

SEQ ID NO: 412 - DNA, 20 bp, Trichoderma reesei
acgcgcaacaaccgccgcac

SEQ ID NO: 413 - DNA, 20 bp, Trichoderma reesei
ctcacattctctattcacga

SEQ ID NO: 414 - DNA, 20 bp, Trichoderma reesei
gacgctgcctcatctagtcg

SEQ ID NO: 415 - DNA, 20 bp, Trichoderma reesei
gcccgaccggttcaacgtcc

SEQ ID NO: 416 - DNA, 20 bp, Trichoderma reesei
ttcgacaagctcacttacaa

SEQ ID NO: 417 - DNA, 20 bp, Trichoderma reesei
cctcgactcgcgcttcgtca

SEQ ID NO: 418 - DNA, 20 bp, Trichoderma reesei
cttcgactcccactccaaga

SEQ ID NO: 419 - DNA, 20 bp, Trichoderma reesei
gtcgctgcctccctcacacg

SEQ ID NO: 420 - DNA, 20 bp, Trichoderma reesei
cgccgctgccctcttcgaaa

SEQ ID NO: 421 - DNA, 20 bp, Trichoderma reesei
cgtcacagagcacttcttcc

SEQ ID NO: 422 - DNA, 20 bp, Trichoderma reesei
cagcacgactccatctacgc

SEQ ID NO: 423 - DNA, 20 bp, Trichoderma reesei
aaccacatcgccgagaacaa

SEQ ID NO: 424 - DNA, 20 bp, Trichoderma reesei
ccttgtctatgcgaatgacc

SEQ ID NO: 425 - DNA, 20 bp, Trichoderma reesei
agcagcagcagcacgagcag

SEQ ID NO: 426 - DNA, 20 bp, Trichoderma reesei
cgctgcccatcatccacgcg

SEQ ID NO: 427 - DNA, 20 bp, Trichoderma reesei
tccacgtttgagctgcgtgt

SEQ ID NO: 428 - DNA, 20 bp, Trichoderma reesei
atccccatccaccagaagcg

SEQ ID NO: 429 - DNA, 20 bp, Trichoderma reesei
cgtcttcgaccgaatacaag

SEQ ID NO: 430 - protein, 374 aa, Trichoderma virens
MLNPRRAFIAAAFLLTVFFLITRSHSSEPSPATKTESQDAQAEAQAAANTQQRILPPPPPQKPMIDMSGMSTYEKLAYQYEYDIESKFPAYIWQTWKHTPGEGEFQFREQEASWSIEHPGFIHEVITDSVADTLLQLLYGSIPEVLEAYHALPLPVLKADLFRYLILYARGGIYSDIDTYAIRSAIEWIPAQIPKETVGLVIGIEADPDRPDWADWYSRRIQFCQWTIQSKPGHPVLRDIISRITNSTLTMKKEGKLSQFQGNRVVDLTGPAVWTDTIMDYFNDERYFDMANSKGKIDYRNFTGMETSKRVGDVVVLPITSFSPGVGQMGAKDYDDPMAFVKHDFEGTWKPESERHIGEVQQELGEGEEAPKQQ

SEQ ID NO: 431 - protein, 389 aa, Trichoderma atroviride
MLNSRRAIVAAVFILTVFFLLTRSHTTTPVVPAAKNAATTAVDTSKNDAPASNQVVSPPPEEQKEMEVKERRTRPRIDMSGMSIQEKLEYAYPYDVATKFPAYIWQTWKQSPDQGDFQFKDHHASWREEHPGFVHEVITDDVAVNLIRLLYATVPEVIEAYRSLPMPVLKADFFRYLILFARGGIYSDIDTYAIQSSVKWLPEQIPRDTIGLVIGIEADPDRPDWAQWYSRRIQFCQWTIQAKPGHPVLRDIITRITKKTLELKNQGKLEKFIDRNVVEFTGPAVWTDAIMEYFNDPRFFDMSQSKGTIDYKNFTGMETSKRVGDVVVLPITSFSPGVGQMGAKEPDDPMAFVKHDFEGTWKPESERHMGEQQQQEGQQAAQAPQAPLQ

SEQ ID NO: 432 - protein, 389 aa, Fusarium oxysporum; identical to SEQ ID NO: 431

SEQ ID NO: 433 - protein, 414 aa, Fusarium graminearum
MLNSRRAIVAAVFVLTVFFLLTRSHSSTPVVPAAQNAAAAADTSKNDAPASNEAVPPPPEKKEPEMEVKERRTRPRIDMSGMTTYEKLEYAYPYDVTSKFPAYIWQTWKQSPDQGDFQFKDHHGSWREEHPGFVHEVVTDDVAVNLIRLLYATVPEVVEAYRSLPMPVLKADFFRYLILFARGGIYSDIDTYAIQSSVKWLPEQISRDTIGLVIGIEADPDRPDWAQWYSRRIQFCQWTIQAKPGHPALRDIINRITKKTLDEKRKGTLETFVDRNVVEFTGPAVWTDAIIDYFNDGRFFDMSQSKGTIDYKNFTGMETSKRVGDVVVLPITSFSPGVGQMGSKEPDDPMAYVKHDFEGTWKPESERHMGEQKQEEGQQAPLQQEGQPQQGQPQQGQPQQGQPQQQQQPPPAQQ

SEQ ID NO: 434 - protein, 372 aa, Neurospora crassa
MLTFRRALVAAAFFLTIFYLISSSSSNPPSTTTPAVPKTDADVETAKHASTTAVTDKSSSGANAAQQNPQGQRPIQDMSRMTLYEKLAYQFPYDVESKFPAYIWQTWKWTPAHGEFNFRDQEATWTQQHPGFIHEVITDKVAVHLIRLLYASVPEVVEAYNALPLPVLKADFFRYLILLARGGIYSDIDTYAIRSAVEWIPDSVPKDAIGLVIGIEADPDRPDWKEWYSRRIQFCQWTIQSKPGHPVLREVVSRITNVTLAMKRNGTLRGVVDKNVIEFTGPALWTDVIFEYFNDQRYFDMTHSAGSIDWKNFTGMEASKRVGDVVVLPITSFSPGVGQMGAKEYDDPMAFVKHDFEGTWKPESERHIGENK

SEQ ID NO: 435 - protein, 474 aa, Myceliophthora thermophila
MLSFRRALVAAAFFLTILFFTTRSTSPAASSLAVEFPKSPSDPGSKDDSQSTTSTDTGNAVHAGGNDRDRTPSNGQQPMHDMSKMTLHEKLAYQFPYDVESKFPAYIWQTWKWTPAHGEFHFREQEATWTELHPGFIHEVITDQVAVYLIRLLYASVPEVVEAYEALPLAVLKADFFRYLILLARGGIYSDIDTYALRSALEWIPDTVPRDTVGLVIGIEADPDRPDWNQWYSRRIQFCQWTIQAKPGHPVLREVVARITQKTLERKKAGSLKEVTNDRVIEFTGPALWTDTIFEYFNDPRYFDLSQSPGPIDWRNFTGMENPRRVGDIVVLPITSFSPGVQQMGAKDYDDPMAFVKHDFEGMSPFPPLLALFFLAPTCPSLTWVRVHKGPGNPRANGISASSGTLPTLLSIFDDVLSASLGDDAHSLLISFYKPAWFGVIMVVKHCIISGWLLEGRGRIESVQKTAVCSHVSL

SEQ ID NO: 436 - protein, 359 aa, Aspergillus fumigatus
MLTFRKSLIVAVVLITFVVLLRSAHSSPSAEPAVLNTETTAHDTSQAADEHLTDQKQDIQQQPLKPPPTAPLRERLRYQFPYDLENRFPAYIWQTWKYTPASMWFSEDLRPAEASWTELHPGFVHEVIPDDTQRHLVKYLYGSVPEVFEAYDSMPLPVLKADFFRYLILLARGGIYSDIDTYALKPAVDWLPGELDLATVGFVIGIEADPDRPDWHDWYSRRIQFCQWTIQAKPGHPILRDIVAYITEEALRMKKKGILKEGKMDKTIVEFTGPAAWTDAVFRYFNNPEYFSIEPGSTHNVTYEDFTNQRGYKKVGDVVVLPITSFSPGVGQMGAGDLDDPMAFVKHDFSGSWKTDPAL

SEQ ID NO: 437 - protein, 362 aa, Aspergillus niger
MLTFRKSLLAAALLITFIVYLRSSHTASSLPSPDTSSAGHLYNQDYDGHADNERKGGTRDTVQQLPLTPPPSAPLRDRLRYHFPYDLEAKFPAFIWQTWKYAPSSMFFSESLRDPESSWSELHPGFVHEVVPDDTQRHLIKYLYGAVPDVFEAYDAMPLPVLKADFFRYLILLARGGIYSDIDTTALKPASDWLPAELDLATVGAVVGIEADPDRPDWHDWYARRIQFCQWTIQAKPGHPIMRDIVSYITEETLRMKKAGILKTGKMDKTVMEYTGPGAWTDAVFRYFNDPEYFNIEPGSTLNITYEDFTGQEGYKKVGDVVVLPITSFSPGVHQMGAGDVDDPMAFVKHHFEGTWKDDPSL

SEQ ID NO: 438 - protein, 363 aa, Aspergillus oryzae
MLTYRKSLIAALFLITFVVLLRSSHSASSPSPPAPAHLPDEVAYNTNEVTEEHLSGQKKEAIPQQQPLKPSPSAPLRERLRYHFPYDLDKKFPAYIWQTWKYTPDSVWFGQELRGAEASWTELHPGFVHQVVPDDTQGYLIKYLYSSLPDVFEAYESLPLPVLKADFFRYLILLARGGIYSDIDTSALKPAADWLPSTYDLSTIGFVVGIEADPDRPDWHEWYSRRLQFCQWTIQSKPGHPILRDIVAYITEETLRMKKAGILKVGKMDKTIVEFTGPGAWTDAIFRYFNDPDYFNIEPDSNHNITYEDFSNQKDWRKVGDVVVLPITSFSPGVMQMGAGDYDDPMAFVKHDFEGSWKTDPSL

SEQ ID NO: 439 - protein, 362 aa, Aspergillus nidulans
MLTFRKALIVAAIFITLILFLRSSHSGPESAAAASPEDIAYEISQETKGKTSSESSDSTQQQPLKQPPPPATAPLRERLRYHFPYNLEAKFPAYIWQTWKYTPASVWFSQDLRRPEASWTEMNPSFVHQVIPDDTLHHLVKYLYGSIPEVLEAFNSMPIPVMKADFFRYLILLARGGVYSDIDTTALKPVVDWLPDSLDLSTIGFVVGIEADPDRPDWHDWYSRRIQFCQWTIQSKPGHPILLDIVTYITQEALRMKKAGILKKGKMDKTIVEFTGPAAWTDAVFRYFNDPEYFYVEPGTTRNITYEDFTNQVEYQKVGDVVVLPITSFSPGVQQMGAQGIDDPMAFVKHNFGGTWKTDPSL

SEQ ID NO: 440 - protein, 360 aa, Penicillium roqueforti
MITPRKVLLALFCVVTFVLILRSFRDPEVPGAPGYRPVKKISQEEDEAIANLARKIPPQGRAQLPLGASRTTPLRERLRYQFPYEIENRFPAYIWQTWKYSPGSFWFDEDLRGPEASWTEMHPGFTHEVIPDDTQQHLIKYLYGSVPEVFEAYDSLPLGVMKADFFRYLVLLARGGIYSDIDTSALKPAHTWLPEELDRSTIGFIVGIEADPDRDDWHDWYSRRLQFCQWTFVSKPGHPILRDMVAYITEHALRMKKAGILKVGKMDKTIMEFTGPGAWTDSIFRYFNNPAYFNIQPGDKNITYEDFSHQTTHRKVGDVVVLPITSFSPGVGQMGAGDTDDPMAFVKHNFGGTWKTDPSL

SEQ ID NO: 441 - protein, 360 aa, Penicillium chrysogenum
MITPRKVLLSLLCVVTFVLILRSFRDPEVPGAPGYRPVKKISQEEDEVTSNLARKTPPQGRAQLPLGASPTAPLRERLRYQFPYGIENKFPAYIWQTWKYDPGSFWFDEDLRGLEASWTEMHPGFTHEVIPDETQQHLIKYLYGSVPEVFEAYDSLPLAVMKADFFRYLVLLARGGIYSDIDTLALRPAHTWLPEELDRSTIGLIVGIEADPDRDDWHDWYSRRLQFCQWTLVSKPGHPILRDMVAYVTEHALRMKRAGILKVGKMDKTIMEFTGPGAWTDSVFRYFNNPAYFNIQPGDKNITYEDFSHQTTHRKVGDVVVLPITSFSPGVGQMGAGDPDDPMAFVKHNFGGTWKTDPSL

SEQ ID NO: 442 - protein, 347 aa, Trichoderma virens
MLATLSLASPVKNLRAEPTDLPRLIVYFQTTHDQNNNPISMLPLINEKGIALTHLIVCSFHINQGGVVHLNDFPPDDPHFYTLWNETITMKQAGVKVMGMVGGAAPGSFNSATLDSTNSTTFEHYYGQLRDTITNFQLEGMDLDVEQPMSQAGITRLVARLRADFGPDFLITLAPVASALENSSNLSGFNYNTLRTAQGSNIAWYNTQFYSGFGSMQSTSDYDRIVANGYTPDTVVAGQLTTPEGAGWIPTSNLNTTIISLVNKYGQIGGVMGWEYFNSLPGGTSEPWEWAQIVTEILRPNLVPDLRITQEDADRLQSAYAASVKATGKDKSFVKKPSVDYNAMVNA

SEQ ID NO: 443 - protein, 362 aa, Trichoderma atroviride
MKSAFVFLASMLATLSLAAPVQDVAVARSEPTDLPRLVIYFQTTHDQNNNPISMLPLINEKGIALTHLIVCSFHINQGGVIHLNDFPPDDPHFATLWNETVIMKQAGVKIMGMVGGAASGSYSTSTLDSSNSTTFEHYYGQLHDLIVNFELEGMDLDVEQPFSQSGVNRLISRLRSDFGPDFLITLAPVATALENSANLSGFNYNQLQTDEGSSIDWYNTQFYSGFGTMESPNDFINIVNTGYSPDIIVAGQLTTPNDGGGWIPTADLNNTIITLDQTYGQIGGVMGWEYFNSLPGDTSAPWEWAQIVTEILRPGLTPELKITKQDAARLQAAYATSVAANGGKDKSFAAKPSVNYSKWVNA

SEQ ID NO: 444 - protein, 406 aa, Neurospora crassa
MRSTIFRAATALMAILTPIIVTAANPLQIRTHINGHTLSPRATFAYGQGNTTDVIIRTEIPRLIIYFQTTHDESGKPISMLPLVTEKNIALTHLIVCSLHIQKDGNITLNDHQPTDPRYGTLWQETQILGYAGVKIMGMIGGAAAGSFTPDTLDSANETVFNRYYGQLHETIKRYGLQGLDIDVEQPMSQGGIERLILRLRADFGKDFIITLAPVASALTMGGWNLSGFDYRKLMLAPSGAGKEVAFYNCQFYSGFGDAGNPNQFHQIITDNAQRDMRGALSPTKIVIGQLTNPNNGGGFVTAGTLANSIKTLRDVYGQIGGVAGWEYFNGQPGGVEEPWKWAQTMTAILRPNQVPKLKLTVEMAVKLKDVWKESAAAGMRQVVGNVKVQLEGLEPTVDYMAMVNA

SEQ ID NO: 445 - protein, 346 aa, Fusarium graminearum
MPPLPPSANPLPRLVTYYQTHHDSSGNLISTLPLITQPGIAITHVIVAAIHINEDPEKIALNDYHPSHPIFQTMWAELRILQASGVKVMGMLGGACKGSYARLDADENTFERFYCPVRDMIRERALDGLDLDVEEVMSLGGIVRLIDRLRSDFGPTFIITLAPVAMSLIDFRRNLSGFDYEALEVMRGRDIAWYNTQFYCGWGDCSNPLMYDLMVQKGWPPEKIVIGLLTNPENGHGYVPFNPLGMVLTTLRGRYGNFGGVMGWEYFNGLPGGKERPWEWAREMTELLRGHILSEPAQVTQLTQQQQPVPVESAPKKNEEVDPDTPGGKDVALPKQFDYYTDGSDA

SEQ ID NO: 446 - protein, 358 aa, Myceliophthora thermophila
MPPLPQPPALPRVITYYQTHHTPSGKPISVLPLLQQPGIGITHVILAAIHINEDPAGLTLNDHPPSDPRFTTLWAEMRVLQASGVKVLGMLGGAAPGTYARLDLNGNGNGNGNGGDDDGAFEAYYRPLAELIRERGLDGLDLDVEEPMSLGGIVRLIDRLRADFGPDFLITLAPVASALLDPLRNLSGFDYEALEVLRGRDIAWYNAQFYCGWGDCSNPVMYEMLLAKGWPPDKIVVGLLTNPDNGSGWVPWNLLSGVLPLLAGRHPRFGGVMGWEYFNSLPGGKERPWEWAQAMTALLKGRRAVQSLEGLQGSEKPAEEKKTSEVSPEADPDEEQPGEAPPVPAEFEYHSDGGGEEE

SEQ ID NO: 447 - protein, 305 aa, Aspergillus nidulans
MPPIPPPSYPHRIVLYHQTLHPDRGPYVSMLPLLNNHTGTTHVILAAFHLNAPNPNHITLNNDPPDNPMYDRLWAEVSILQESGIKVMGMLGGAAPGTFTCLDGDEAQFEQYYGPLLDMIRRHGLDGIDLDVEEPMSLAGIVRLIDRLKADLGERFIITLAPVAAALLGIGNLSGFDYRLLEQQRAGSIAWYNTQFYNGWGPADDPRMYAAIVAQGWSPARIVYGLLTNPGNGSQGYVPQEVIGPVLATLVEQFPNFGGVMGWEYFNSMPGRLERPWEWAAQMSLNMGLNKVLRIARELLVSRSR

SEQ ID NO: 448 - protein, 322 aa, Penicillium chrysogenum
MPPIRGGLGERPRVILYHQTLIPGGGQYVSMLPLLENNTGITHLILAAFHLNGAPGDITLNDDPPDSAKFDPLWAEVPVMQQQGVKVMGMLGGAAPGSFTRLDGSRAEFEQFYYPFLTMIRRHGLDGIDLDVEEAMSLQGIIRLIDRLKADMGDAFIITLAPVAAALLGIGNLSGFDYRELEQARASKIDWYNAQFYNGWGLAEDPRMYAAMVSQGWSPRRIVYGLLTNPGNGSQGYVSQEKIGPVLAMLVEQFPNFGGVMGWEYFNALPGGTAKPWQWAAAMSLSMGIRDVVAVARQLMSAGPMASTLNNLFQDMLNQGHQ

SEQ ID NO: 449 - protein, 290 aa, Apergillus fumigatus
GPMPPVPGRPEHRRVICYHQTLCPNRGDYVSVLPLVKNNTGVTHIIIAAFHLNEDPGHITLNDDPPDHEMYNPLWAEVPVLKRSGVKVMGMLGGAAQGSYRCLDGDQEKFERYYQPLLAMVRRHQLDGLDLDVEEEMSLPGIIRLIDRLKLDLGDDFIITLAPVAAALLGIGNLSGFDYRQLEQQRGSKISWYNAQFYNGWGLAEDPRMYAAIVAQGWSPQRVVYGLLTNPGNGSQGYVPRERIGPVLAVLVEQFPNFGGVMGWEYFNSIPGEQQSPWQWAAEMSLSMHM

SEQ ID NO: 450 - protein, 339 aa, Aspergillus oryzae
MPDHGIAYPRLPSEFNEVTNPIPNLRPHQARKIVIYYQTMTVSLKDLAVAYLIESWLQMETLTHLIVGCFHLGRNGYLHLNNHTPDHESFTELWQDKQTLQQRGLKVLAMLGGACPGSFIVLDEDESFQECYKTLYDMLVKYKFDGIDLDIEEPISQNGINRLVDRLRADFGPNFIITLAPVATALQGKAHLSGFDYLRFEGERGDKINFYNTQFYNGWGSLETTKDYDAIMAMGFPPSRVLPTLLTHRNNGTAGFIEFDKLRPVLIELRLRYPYLGGVAGWEYFNSDPGGQEMPYQWLAIVSFIETSVYLLGPDHRRLLSFARTQQSRGHPRDSLLGQ

SEQ ID NO: 451 - protein, 317 aa, Aspergillus niger
MPPVSPQPERPRVILYHQTICPDGQYCSMLPLLDNNTGVTHIILAAFHLNADPQHITLNNDPPHMPLYEPLWAEVPAVKQSGVRVMGLLGGAAQGSFRCLDGNEEKFELYYQPLRDMVRRHQLDGLDLDVEEEMSLSGIIRLIDRLKLDMGDDFIITLAPVAAAMLGMGNLSGFDYRELERQRASKISWYNTQFYNGWGNPEDPRMYAAMVAQGWAPNRVVYGLLTNPGNGSQGYVPLEKIGPILGLLVERFPNFGGVMGWEYFNSKPGDRDAPWQWAAAMSLSMHMKEVLHVARMMRSGPMANSLMNLLRDMMQQR

SEQ ID NO: 452 - protein, 540 aa, Rhizopus microsporus
MLARTFLGMAISAFLASTGVQAAWSSNGPNVMYYWGQNSAGGSNTQASLGTYCESGQVDAVLLSFLHVFNVGGTPEINLSSACAGTYFPNTQLLSCPAVGADIKKCQDKGVKVILSLGGAAGVYGFTSDAQGQQFAQTIWNLFGGGSSDTRPFGDAVIDGVDLDIEGGASTGYAAFVNALRQKFSSNFLIGAAPQCPFPDAILGSVLNSASFDYVNVQFYNNYCSATGSSFNFDTWDNWAKTTSPNKNVKIMFTIPGSPTAAGSGYVPMSTLQTIVPSLASEYSSYGGVSVWDASQAWNNGDFSSQLYSLVHSGGSTPPPSSSTIKTTTKATTTSTKTTTTAAPTATSAPGSCPVANQSCSTQNQYACTADGKYAVCDHGKWVVSSCPSGTVCIPTTDGTSIYCGYATGSGSTCPSASALEIAAASFGSKNGPVPRPYKASKVAAQLAVTSTDKNSFEAVINARRTTLTPFEKSVTIEFTTPSNIKFTESDMGPVRQVGNKVRIQAKNDYNESMTLVVKVKGSINSGVFVAPSTSAWKFK

SEQ ID NO: 453 - protein, 493 aa, Rhizopus niveus
MISCNILGITIAAFITSTLAAYSSNGVNVMYYWGQNSAGGSNTQGSLVSYCQSGQVDVIILSFLNKFNMGGLPEINLASACEQTFFPNTNLLHCPTVGSDIKTCQSNGVKVLLSLGGAAGSYGFSSDSEGQTFAETIWNLFGGGTSDTRPFDDAVIDGIDLDIEGGSSTGYAAFVTALRSKGHFLIGAAPQCPFPDAILGSVIDAVGLDFVNVQFYNNVCSVASGSSFNFDVWNDWAKNKSPNKNIKVMLTVPGSSTAAGSGYASIAELGPIVSSVISQYSSFGGVSVWDASQAWNNNGFHSELYSIVHGSSAALGQAARKTPFPNTSSITTTSLATASSALFPLLYAGRSCSSQSKVSCTSTGSYTICNYGKWVTAPCPPGVICLSSAQSNNTDLTVSAQFFITSFAGGSFKAIINARRTTLTPFEKMKTIEFTVPDHVRLSQCNLGKIEQVGRSVRIRLKDHPNMAFVLNLSGNVSSDAFVAPDPSSWRFS

SEQ ID NO: 454 - protein, 549 aa, Mucor circinelloides
MLLRFIGITAAALLSSCGVQAAFSSSSPNVMYYWGQNSAGGSSTQGSLASYCNSGQADVVLLSFLHIFNVGGLPGINLSSACETTFPGTSLLTCPAIGNDIKTCQSKGVKIILSLGGAAGSYGFTSDAQGQTFAQTIWDMFGGGSSTYRPFGDSVIDGVDLDIEGGPSTGYIAFVNSIRSKFSSGFLVGAAPQCPFPDVILGSVLDGVGLDFVNVQFYNNYCSAVGNSFNYDTWANWAKTKSPNKNVKVYFTIPGAPTAAGSGYAPISTIQTIVPQLASQYPGIFGGVSVWDASQAWNNAQFASQLYSLVKGSGGGGVTTTKTTTTTTATSTQSTPNSSSSSTKTSTSTSSSATATATSTPGTCAAAGQACSTEGKYVCTSGGAYAVCLYGKWSVTSCPSNTQCIPTTDGASIYCGYSNGSTTCSALSARDILHATLNKGGAVPKPYKASQVQAQFVVASASADAFKAVINAHRTNTKPFGKTVTIEFTAPSNVKFSSADAGTVRQVGNSVRIQAKSDFDKNMAIVVAVQGSVKSGVFVAPNPSSLRIK

SEQ ID NO: 455 - DNA, 2418 bp, Trypanosoma congolense
atgtatcggaagttggccgtcatctcggccttcttggccacagctcgtgctaaggaaatcctcagcctgaacagcggccacttcctcgacgtcgtcgactacggcggcggcattctccgagccgccgtcaagcctcgcaaggactggttctacgaggtcgacagcgtcgtcgtcaagaaccccgtcgccggcgagatccagcccaagtgcgaaggcaccagctgcaccgtcaccagcgagaactgcgccctcagcaccgtcgtggacgaccagaagatccagctcagctacgcctgcggcggcctccgactcgcttctgtcgaggtccctcaggaccgcctcgaggaacccagcctcaccatgcgcttccccaaggcccaccgcctctacggcatccccgagcacagcatggacctgcccctcaaggacaacgccacctacgagatgttcaacaccgacgccttccagtacaagatcaacaaccccgagcccctctacggctcgatcccgttcctcctggcccacagcaaggaagtcagcaccggcatcctgttcctcaacagcgccggcatgaacgtcaaggtcctcaccgagaacggcctcggctgccagtgggatgctgaggcgggcctggtcgacctgttcttcttccctggccccacccctgccctcgtccagcagcagcatgccagcatcaccggccctaccgccctgcccccctacttcagcctcggctttcaccagtgccgctggaactaccgcagcaccgaggacagcctcagcgtcgaccacggcttcgaccagcacaacctgccctacgacaccctctggctcgacatcgagcacaccgacaacaagaagtacttcacctgggacaaggacaccttccccgaccccaaggtcctcgtcaaggccctcgccgcttctggccgcaagctcgtcaccatcaaggacccccacgtcaaggtcgagagcggctactacgtctacgacgaggccatgagcggcaaccacttcgtcaagaacgccgacgacgaggaaccctacgtcggccagtgctggcctggccgatctagctggcccgacttctacaacaagcgcacccgcgactggtacgccaccctcttccaccacgaccgctacgagggcggcagccacgacgtccatacctgggtcgacatgaacgagcccagcgtctttgaggcccccgacaagaccctccgacgcgacgcccgacataccagcgacagcggcaacgtcgtcgaccacaagttcatccacaacatctacagcctctacaccgtcatggccgcccaccagggccacatcgagagcagcaagggcctcaaccacgtcaagcgcccctttatcctgacccgcagcttcttcagcggcagccagcgctacgccgccatgtggaccggcgacaacatggcccgatgggaccacctccagaacagcttccccgagctgctcagcctcagcatcagcaactacgtctttatcggcgccgacgctggcggcttcttcttcgacccctccgaagaactcttcgtccgctggatccaggccagcgtcttttaccccttcatgcgcacccactcccacatcgagacaaagcgccgcgagccctgggtctatggcgacgccgccaccgaccgaattcgagccgccctcgccctccgctacagcctcatcccctacatctacacccagatgtttatcgcccaccgcaccggcagcaccatcatgcgccccctgttctacgagttcccccacgaggaacagttctacgacgagcagtacacctttatgttcggccccagcctcctcgtcagccccgtcgtcaaggaaggcgagacagagaagcagatccccatccccagcggcagcaagtggtacagctacaccaccggcgaggtcgtcccccctggcaaccaccacatgaaggtcgacatggacaccatccccatgttcctccgaggcggccacatcatccccgtcaagctccgcatccgccgagccaccctcgccatgaagcacgacccctacaccctctacgtcgccctcaacgagaagggcaactctgccggcgagctgttcatcgacgacggcgagagcttcgactacgagagcggcgcctacatctaccgctacctcaccttcagcgacggcaagctcaccaaccgcgcccacccgaacagcaccgccagcagcctcttcaccgccaagaacaaggtcgagcgcatcgtcatcttcggctacgagggcaagcccagcgtcgccatggtcgaggtcgtcacccagagcatcaaggtcggcaaggaaatcgagtacgacgtcaagggcggcgccctcgtcctgaagaaccccggcctccacatcggcgaggactgggtcatcgtcctcaagaagtga

SEQ ID NO: 456 - protein, 805 aa, Trypanosoma congolense
MYRKLAVISAFLATARAKEILSLNSGHFLDVVDYGGGILRAAVKPRKDWFYEVDSVVVKNPVAGEIQPKCEGTSCTVTSENCALSTVVDDQKIQLSYACGGLRLASVEVPQDRLEEPSLTMRFPKAHRLYGIPEHSMDLPLKDNATYEMFNTDAFQYKINNPEPLYGSIPFLLAHSKEVSTGILFLNSAGMNVKVLTENGLGCQWDAEAGLVDLFFFPGPTPALVQQQHASITGPTALPPYFSLGFHQCRWNYRSTEDSLSVDHGFDQHNLPYDTLWLDIEHTDNKKYFTWDKDTFPDPKVLVKALAASGRKLVTIKDPHVKVESGYYVYDEAMSGNHFVKNADDEEPYVGQCWPGRSSWPDFYNKRTRDWYATLFHHDRYEGGSHDVHTWVDMNEPSVFEAPDKTLRRDARHTSDSGNVVDHKFIHNIYSLYTVMAAHQGHIESSKGLNHVKRPFILTRSFFSGSQRYAAMWTGDNMARWDHLQNSFPELLSLSISNYVFIGADAGGFFFDPSEELFVRWIQASVFYPFMRTHSHIETKRREPWVYGDAATDRIRAALALRYSLIPYIYTQMFIAHRTGSTIMRPLFYEFPHEEQFYDEQYTFMFGPSLLVSPVVKEGETEKQIPIPSGSKWYSYTTGEVVPPGNHHMKVDMDTIPMFLRGGHIIPVKLRIRRATLAMKHDPYTLYVALNEKGNSAGELFIDDGESFDYESGAYIYRYLTFSDGKLTNRAHPNSTASSLFTAKNKVERIVIFGYEGKPSVAMVEVVTQSIKVGKEIEYDVKGGALVLKNPGLHIGEDWVIVLKK

SEQ ID NO: 457 - protein, 961 aa, Aspergillus niger
MSNRWTLLLSLVILLGCLVIPGVTVKHENFKTCSQSGFCKRNRAFADDAAAQGSSWASPYELDSSSIQFKDGQLHGTILKSVSPNEKVKLPLVVSFLESGAARVVVDEEKRMNGDIQLRHDSKARKERYNEAEKWVLVGGLELSKTATLRPETESGFTRVLYGPDNQFEAVIRHAPFSADFKRDGQTHVQLNNKGYLNMEHWRPKVEVEGEGEQQTQEDESTWWDESFGGNTDTKPRGPESVGLDITFPGYKHVFGIPEHADSLSLKETRGGEGNHEEPYRMYNADVFEYELSSPMTLYGAIPFMQAHRKDSTVGVFWLNAAETWVDIVKSTSSPNPLALGVGATTDTQSHWFSESGQLDVFVFLGPTPQEISKTYGELTGYTQLPQHFAIAYHQCRWNYITDEDVKEVDRNFDKYQIPYDVIWLDIEYTDDRKYFTWDPLSFPDPISMEEQLDESERKLVVIIDPHIKNQDKYSIVQEMKSKDLATKNKDGEIYDGWCWPGSSHWIDTFNPAAIKWWVSLFKFDKFKGTLSNVFIWNDMNEPSVFNGPETTMPKDNLHHGNWEHRDIHNVHGITLVNATYDALLERKKGEIRRPFILTRSYYAGAQRMSAMWTGDNQATWEHLAASIPMVLNNGIAGFPFAGADVGGFFQNPSKELLTRWYQAGIWYPFFRAHAHIDTRRREPYLIAEPHRSIISQAIRLRYQLLPAWYTAFHEASVNGMPIVRPQYYAHPWDEAGFAIDDQLYLGSTGLLAKPVVSEEATTADIYLADDEKYYDYFDYTVYQGAGKRHTVPAPMETVPLLMQGGHVIPRKDRPRRSSALMRWDPYTLVVVLDKNGQADGSLYVDDGETFDYKRGAYIHRRFRFQESALVSEDVGTKGPKTAEYLKTMANVRVERVVVVDPPKEWQGKTSVTVIEDGASAASTASMQYHSQPDGKAAYAVVKNPNVGIGKTWRIEFHDEL

SEQ ID NO: 458 - DNA, 3004 bp, Aspergillus niger
atgtccaaccgttggaccctactgctgtccttggtgatcctactcggatgccttgtcatccccggaggtaagcctatccaatcacactcctagtggtgaggctctccttgacatctaacaatgacgcatagtcaccgtgaaacacgagaacttcaagacatgttctcaatcgggcttctgtaagcggaacagagcattcgccgacgatgctgccgcccaaggttcctcctgggcctccccatacgaactcgactcatcctccatccagttcaaggatggccaattgcacggaaccattctcaagtccgtctcccccaacgagaaagtcaagctgcctctcgttgtctccttcctcgagtccggcgccgcccgagttgttgtcgatgaggaaaagcgcatgaacggtgacatccagcttcgacacgatagcaaagcacgcaaggaacgctacaatgaggcagagaaatgggtgttggttggtggcctggagttgagcaaaaccgcgaccttgagacctgaaaccgagtctggctttaccagagtcttgtacggtccggacaaccagttcgaggctgtcatccgccacgccccctttagcgccgacttcaagagggatggccaaacccacgttcaattgaacaacaagggctaccttaacatggagcattggcgccctaaggtagaggtcgaaggcgagggcgagcagcaaacccaggaagatgaaagcacttggtgggatgagagctttggtggaaacacggacaccaagcccaggggtcccgagagtgtgggattggatatcaccttccctggctacaagcatgtttttggaattcctgagcatgctgactctctctccttaaaggaaactcggtaagctagtcgcgcagtgacattttccatctcgcagaactgacagcgtcccagaggtggtgaagggaatcacgaagagccctaccgcatgtacaatgcggatgtatttgagtacgagctgagcagtcccatgaccttgtatggtgctattccattcatgcaggcacatcgcaaggactccaccgtcggtgtcttctggctgaatgctgcagagacctgggtggacattgtcaagtctacctcatctcctaaccctcttgctctcggcgtgggcgccaccactgacacccagagtcattggttttcggagtccggccagctcgacgtgttcgttttccttggtcctaccccacaggaaatcagcaagacctatggtgaactcaccggctacactcagttgcctcaacattttgccattgcttatcaccagtgccgctggaactacatcactgatgaggatgtcaaggaggtcgatcgcaactttgacaagtaccagatcccctacgatgtcatctggctggacatcgaatataccgatgacagaaagtatttcacctgggatccactcagtttccctgatccgatcagcatggaggagcagctcgatgagtcggagcgcaaactcgtcgttatcattgacccgcacatcaagaaccaggacaagtacagcatcgtccaagaaatgaagagcaaagacttggccactaagaacaaggacggtgagatctacgacgggtggtgttggcctggctcttctcactggatcgataccttcaaccccgccgccatcaaatggtgggtcagcttattcaagtttgacaagttcaaggggacgctgtccaatgtcttcatttggaacgacatgaacgagccctcggttttcaacggtcccgaaaccacgatgcccaaggataaccttcatcatggcaactgggagcaccgtgacatccataacgttcatggaatcaccctggtcaatgccacctacgatgcccttctagagcgcaagaagggcgagatccgtcggcctttcattctgacacggtcatattatgctggtgctcaacggatgtctgctatgtggacgggtgataaccaggctacttgggaacacttggccgcttccatccctatggttctgaacaacggcattgcgggcttcccctttgccggtgctgacgtgggcggtttcttccagaaccctagcaaggagctcttgaccagatggtaccaagctggtatttggtaccccttcttccgggcccacgcgcatattgacacgcgccggagagagccgtatctgattgccgagccacaccggtctatcatctcccaggctatccgcctgaggtatcagcttctccccgcctggtacactgccttccacgaagcttccgtgaacggaatgccgatcgtgaggccgcagtactacgctcacccttgggatgaggctggctttgccattgacgaccagctttatctcggctccaccggtcttcttgctaagcctgttgtctccgaggaggccaccacggccgacatttaccttgctgacgacgaaaagtactatgactactttgactacaccgtctaccagggagccggaaagcggcatacggtgcctgctcctatggagactgtgccattgctgatgcagggtggccatgtaatcccccgcaaggaccgtcctcgccgcagtagcgccttgatgagatgggatccgtacactcttgttgtggtcttggataagaacggtcaagccgatggctctctctacgtggatgacggtgagacgttcgactataagcgtggagcttatatccaccgccgtttccgcttccaggagtctgccctggtctcggaggatgttggcaccaagggtcctaagacggccgagtacttgaagaccatggccaacgttcgtgttgagcgggtggtggtagttgatcctcctaaggaatggcagggtaagaccagtgtgactgtcattgaggatggagcttcggcggcttcgacagcctctatgcagtaccacagccagcccgatggcaaggccgcatatgcggtggtgaagaaccccaatgtcggcattggaaagacatggcggattgagtttcacgacgagctgtag

SEQ ID NO: 459 - DNA, 1903 bp, Aspergillus niger
atgatacttcctcagggatcgctcttcttggtgagcatagctgcttgctcgaccgtcgtggctgcggcgggtgatgcctcctctcgtccccggggtgtaggtcccgaatgtaagtgccacttatatacctacttaggctgaggcggtgctacacgcaaccattctatcccaacttgcatcctcgccataatcttgtttttttgtcggcattggtcatgctaactggtttcgtctaatggttggcagtcgccaagttctacaaggataccaccaccttcacgtgcatctcccacccagccatccagatccccttctccgccgtgaacgatgattactgtgactgtccggatggcagtgatgagcctggcacatctgcctgtgccttcctgtctcgcaacttcgccctaacaccgggtgagcgccccggcagcgacgatctcgagctggcatccgccctgccgggtttctactgcaagaacaagggccacaagcccggctacgtccccttccagcgggtcaatgacggcatctgtgactatgagctctgctgcgacggcagtgacgagtgggcccgccctggcggcaccaagtgtgaagacaagtgcaaggagatcggcaaggaatggcggaagaaggaggagaagagacagaagtccatgactgcggctttgaagaagaagaaggatctgcttgtggaggctggtagacagcagaaggaggtcgaggacaatattaagcgtctggaagttgaaattcaggcccaggagctgaaggttaatgatcttcaggcggagctggaggaggtggagaagcaggaagcgagcaaggtcgtgaagggcaagacggcgggcaaggttaatgtgcttgctgggttggctaagagccgggttgaggagcttcgaaacgccctgatggacgtccgcaaggagcgtgatgatacccgtgcccgtgtgaaggagctcgaagagattctgtctaagttcaaggtggaatacaaccctaacttcaacgatgagggcgttaagcgcgctgtgcgcagctgggaagactacgccgccaagggcacccttgagggcgccgtgaacaacgctcaggaccgtgatttggatgaaattgctaagcccgatgatgagaaggcgggcatcaactgggaacagtgggagaatgaagaggatggatgtgaggctggtcttggtatgtaaatcatttcagaatgagggtcatcgatgttcccgcgctaacatcagatttagtctaccagctggcagcctaccttccgccttctttggtcgagtttatcgaaggcaaggtgctcttcgtcagaggtctcttggaagataacggaattctacccaaggcggccgagacttctacgtccgaatccaaggttgtgtcagaagcccgagaagccgtgaagtcagcagagaaggagcttggagacaagcagaagcagctgaaggatcacaagtccgaccttgagacggactatggtgtcggatccatcttccgtgctctcaagggcgtttgcatctccaaggactcgggtgagtacacgtatgagcactgcttcctggaccagacaaaacagattccgaagaagggcggcggatccacacgcatgggcaagtacaccggcattgggtcggtcagtgttgatgtgctcaacgaggcgggcgagattgtccccgaagacagggtcactcttcagtacgccaacggacaaggctgctggaatggaccggcccgctcgacgacggtcatcctgacatgcggcgaagaggatgcgatcctgaaggtggccgaagacgagaagtgcgtgtactcgatgcatgtcacgtcgccggccgtgtgtcccggaggcgatgagggcgcaactgccccgaaccgcaaggatgagctgtga

SEQ ID NO: 460 - DNA, 1961 bp, Trichoderma reesei
atgcagcgtccggcgtcattggcgctgctgggcgccgtgtgctggactgtggctgctgctggcagcgtgccgcgcggagtcgggccagagtgtgagttgatgctatccggacgacatcacggcagtcgggaggctccagcccagccagactgttcctgagagcctctttcagctccaattgatgccaattggcgttcacatgtccaaccgctaaccccaaatccccaacagtcgtctcctactaccagaacaaggactccttcacctgcatcgccaacccctccatcaccatcccctgggaccgcgtcaacgacaacacctgcgactgccccgacggctccgacgagcccggcaccgcggcctgcgccttcatcgaccctctctcccccgagcagcccctgattggcagcccctcgggcaccaccaatgccacccgctccctgcccggcttctggtgccagaacaagggccacatcggggcctacattcccttttcctacgtcaacgacggcgtgtgtgactacgacgtctgctgtgatggcacggacgagcacaaccatcccaccggcatcaagtgcgagaaccgctgtgggccgattgggaaggagcaccggcggctggcagacgagcggaagaagaacgtggccagggcgattgtcaagaagcaggagatgatcaaggaggccaaggggctacttcggctggctgaggctcgcatcacggcgctggaaaaggacattaaggacctctcggcccagaaggaggagctgcagcgcaaatacgaccaggtgcagagcgaagagcaaggtaagctagtcaagagtgaaggcggcgccggcggcaagctcggcgtgctcgtcggcctcgccaaggagcgcgtggaggagctgcgtgaggctctccggctggtgacggaggaccgcgaggtgctgcgcggcaagagggacgagctcgaggcgatcctcaagcagctcaaggacggccacaacccggacatcaaggatgaaggagtcaaggctgcggtccaggcgtacgaagactacgcggcgcgcgaggcgtcggccgaccagttggagttcctcgagtcggacattcgcgagatcctcaaggaggacgacgagaccaacggggtcaactggaaggcctttgacgagctccatgatgacactgacattcgtaagcacaatcagcttatatctcaattgtcgctctgctgtcgctttttctcctttttcttttttttcttcatggtgtattgcacctctgtgtgttttggctgcctgctgacttgatgtgttttcatcttagtttacaactttgacgcctacatccccccgttcatccgcggcgtcattcacgacaagattcgggtcattcgcaagtggctgatggacaatggcatgattgccgacgaggccaagaccgggtcggaatccagcgccgccagggctgccagggaggcggtcgaggcagccgaccaggagctcggcaacaaggagagggagctccagcaggagaagacggacctcgacaaggactacggaccgtctggcatcttccggtccctcaagggcaagtgcgccgagattgacgccggcgagtacacgtacgagctgtgctggctggacaagacgatgcaaaagtccaaaaagggccacgcggcgaccaatatgggcaactttgagcgcatcgagattgccatggcggacgaggacgagagggtcgacggcaagagcctcggcagcgggccgcggatggtgctgcggtacgagaacgggcagacgtgctggaacggcccccagcgcaagaccaacgtctggctcgggtgcgcggagaaggaggagatttggagggtgacggaggcggagaagtgcgtgtacaagatggaggtgggaaccccggcggcgtgcgaggacgaggagcccgctgctcccaaggactcgggtaaggacgagctgtga

SEQ ID NO: 461 - DNA, 1000 bp, Artificial Sequence
  Primer
caagtcttcgtactctatcgaagtctcgccttacgtacttgatctgctgtctttcgtgtccggtcaacatatactcgcacacattagccccagcagaacatgtcgtcggcataaaaggccaattcagatcgcagataacaaaatgctaccagcatctgtctagttgtggagatatgaaggggtatttcaggctttctttgtgggaataaagagagaaagagagacttacaggagctctaggcttcgtagcccctgcgttcttagttcgcaatgccgtgaaagcagctacatctaccaagacactcgtgcatcgtctattttatttgttacatgctgggaatttccgggacattgtttaaggatgactaggttcagccgttaaagaatggaaggccatggcttgtccctctgtggcaagtcattgcactccaaggccttctcctgtactagtcctacaattctgcagcaaatggcctcaagcaactacgtaaaactccatgagattgcagatgcggcccactggaatacaacatcctccgcaagtccgacatgaagccccttgacttgattggcaggctaaatgcgacatcttagccggatgcaccccagatctggggaacgcgccgcttgaggcccgaagcgccgggttcgatgcattactgccatatttcagcagttaactaggaccggcttgtgtcgatattgcgggtggcgttcaatctattccggcactcctatgccgtttgatccgatacctggagggcgtgctttaggcaaaatgccaagcttcgaggatactgtacgagccgctttcaacctcacttgatgatgtctgagtttcatcaagagaattgaagtcaaagctcaaatcatgatgtgaagaggttttgaatgtggaagaattctgcatatataaagccatggaagaagacgtaaaactgagacagcaagctcaactgcatagtatcgacttcaaggaaaacacgcacaaataatcatc

SEQ ID NO: 462 - DNA, 1000 bp, Artificial Sequence
  Primer
aggggtttgagctggtatgtagtattggggtggttagtgagttaacttgacagactgcactttggcaacagagccgacgattaagagattgctgtcatgtaactaaagtagcctgcctttgacgctgtatgctcatgatacatgcgtgacatcgaaatatatcagccaaagtatccgtccggcgacatgcccatcaactatattgaagtcagaaacacactgtccctcttccctcctatgcttttacaagctgctcctctatccgcccccacagtcccttgttcatataccccgaaagccaaaagtttccatccttgtccttgcccatgatcgggaagccgtttggtagcacgataccccactgattattctgtatatagatcggtgaacccgatttcccaccctccctactgggctgaagcacagctgcagaaaagtccaagtcgaacagctttgccttgccccaatttgacaacgtaatcatgtgcatgttgccgttgccgaagaaaggcggaatcctcccgctagatcctcgccacatagcgaaaaaggcttctacctgagaccgagttcccagttcttgaatcgcggttcgagtagcagcagcaatataactcagcggcttctcaaatatgtggtgcaccggcagtagcacgttgatgaagccggtaccgttggagacatatggcacccctttcggcagcagatccgtctctagacactttcgtagagagtatgcgttgttgatgacaaccgtcctctggctattcgctggcagatgtgaagtggcaactttgatccaccaggcgcagagaacatcgccttcagtcaagaaagtgttttctgcgccctcggactcaagctcactgattgcctctttgcgaaggttctcaatgaaagatccaggaacacaaagcatgcgattctcttgcgctcggaagagatcgaggacattgttgatcccatactgggccagcccaaacattgacaagcgccgaga

SEQ ID NO: 463 - protein, 857 aa, Leishmania major; identical to SEQ ID NO: 103

SEQ ID NO: 464 - DNA, 2673 bp, Leishmania major
aaccaaagactttttgatcaatccaacaacttctctcaacttaattaaatcatgggcaagcgcaagggcaacagcctcggcgacagcggcagcgccgccaccgcctcacgagaggcctctgcccaggccgaggacgccgccagccagaccaagaccgccagcccccctgccaaggtcatcctcctgcccaagaccctcaccgacgagaaggacttcatcggcatcttcccgttcccgttctggcccgtccacttcgtcctcaccgtcgtcgccctcttcgtcctcgccgccagctgcttccaggccttcaccgtccgcatgatcagcgtccagatctacggctacctcatccacgagttcgacccctggttcaactaccgagccgccgagtacatgagcacccacggctggtccgcctttttcagctggttcgactacatgagctggtatccgctcggccgacccgtcggcagcaccacctaccccggcctccagctcaccgccgtggccatccatcgagccctcgccgctgccggcatgcctatgagcctcaacaacgtctgcgtcctcatgcccgcctggttcggcgccattgcgaccgccaccctcgcgttctgcacctacgaggccagcggctctacagtggccgctgccgcggctgccctcagcttcagcatcatccccgcccacctcatgcgctccatggccggcgagttcgacaacgagtgcattgccgtcgccgccatgctcctcaccttctactgctgggtccgcagcctccgcacgcgcagcagctggcccatcggcgtcctgaccggcgtcgcctacggctacatggctgccgcctggggcggctacatcttcgtcctcaacatggtggccatgcacgccggcatcagcagcatggtcgactgggcccgcaacacctacaaccccagcctgctccgcgcctacaccctcttctacgtcgtcggcaccgccattgccgtctgcgtcccccccgtcggcatgagccccttcaagagcctcgagcagctcggcgccctcctcgtcctggtctttctgtgcggcctccaggtctgcgaggtcctccgagcccgagccggcgtcgaggtccgctctcgcgccaacttcaagatccgcgtccgcgtctttagcgtcatggccggcgtggccgccctcgccatctctgtcctcgcccccaccggctacttcggccccctcagcgtccgagtgcgcgccctgttcgtcgagcacacccgcaccggcaaccccctcgtcgacagcgtcgccgagcaccagcccgccagccccgaggccatgtgggcctttctccacgtctgcggcgtcacctggggcctcggcagcatcgtcctggccgtcagcaccttcgtccactacagccccagcaaggtcttttggctcctcaactctggcgccgtctactacttctcgacccgaatggcccgcctcctcctcctgtccggccctgccgcctgcctgagcaccggcatcttcgtcggcacgatcctcgaggccgccgtccagctcagcttctgggacagcgacgccaccaaggccaagaagcagcagaagcaggcccagcgccaccagcgaggcgctggcaagggctctggccgcgacgacgccaagaacgcgacgaccgcccgagccttctgcgacgtctttgccggcagcagcctcgcctggggccaccgcatggtcctctcgatcgccatgtgggcgctcgtcacgacaacggccgtcagcttcttcagcagcgagttcgccagccacagcaccaagttcgccgagcagagcagcaaccccatgatcgtctttgccgccgtcgtccagaaccgcgccaccggcaagccgatgaacctcctcgtcgacgactacctcaaggcctacgagtggctccgcgacagcacccctgaggacgcccgcgtcctggcctggtgggactacggctaccagatcaccggcatcggcaaccgcaccagcctcgccgacggcaacacctggaaccacgagcacattgccaccatcggcaagatgctcaccagcccggtcgtcgaggcccacagcctcgtccgccacatggccgactacgtcctcatctgggctggccagagcggcgacctcatgaagtccccccacatggcccgcatcggcaacagcgtctaccacgacatctgccccgacgaccccctctgccagcagttcggcttccaccgcaacgactacagccgccccaccccgatgatgcgcgccagcctcctctacaacctccacgaggccggcaagcgaaagggcgtcaaggtcaacccctcgctgttccaggaggtctacagcagcaagtacggcctggtccgcatcttcaaggtcatgaacgtcagcgccgagagcaagaagtgggtcgccgatcccgccaaccgagtctgccacccccctggcagctggatctgccctggccagtaccctcccgccaaggaaatccaggagatgctcgcccaccgcgtcccgttcgaccaggtcaccaacgccgaccgcaagaacaacgtcggcagctaccaagaggagtacatgcgccgcatgcgcgagagcgagaaccgccgctagttaattaagatccacttaacgttactgaaatcatcaaacagcttgacg

SEQ ID NO: 465 - DNA, 1347 bp, Xenopus laevis
atgccccgcaaggtcagcgtcgctgcttggggcgctgccctcttcatcagctggaacgccatcctcctgctctacctcatgagccgcagccgcggcaccgaccactctgacctcaccgcccacgtcatccagctcgccgaggccgctgaggccgagcttgagaagcagaagggcctcctccagcagatccaccactacagcggcctgctcaaccagcagcagcccagctctcacgtccgcctcgcccccctcatgcccatcaagaacctcaacgtcagctcgcccttccccagccccgttggctctggccctctccccctcgtcatccccattctcgtcgtcgcctgcgaccgcccttctgtccgacgatgcctcgacagcctcctcaagtaccgccccagcgccgagaagttccccatcatcgtcagccaggactgcggccacgaggaaaccggcaaggtcatcgacagctacggcgacgccgtcacccacatcaagcagcccgacctcagcgaggtcgccgtccctcctgagcaccgcaagttccagggctactacaagatcagccgccactaccgctgggccctcaaccagatcttcaagagcatgggctacaaggccgccatcgtcgtcgaggacgacctcgaggttgcccccgacttctacgagtacttccaggccaccctgcccctgctccaaaaggaccgcatgctctggtgcgtcagcgcctggaacgacaacggcaaggaagccctcatcgaccctggcggcaccagcctgctctaccgcagcgacttctttcccggcctcggctggctcctcctgcgcgagctttgggaggaactcgagcccaagtggcccagcgccttctgggacgactgggtccgacgacctgagcagcgactcgaccgagcctgcgtccgacctgagctgtctcgcacccgcacctttggccgcaagggcgttagccagggccagttcttcgaccagcacctccgcttcatcaagctcaaccaggacctcgtccgcttcaccaagatggacctcagctacctcctcaaggacacctacgacccctggttcctcgagcaggtctacggcgctcctaaggcccgagccgaggaagtccttcacggccaggtccctggcggccgaactgtccgagtcgagtacaccaccaaggacaccttcaaggccatggcccgagccttcggcgtcatggaagatctcaagagcggcgtcgcccgagccgcctacaagggcgtcgtcagctttagccaccgcggacgccgcgtctttctcgcccctcctaaggactggaccggctacgaccccctctggacctaa

SEQ ID NO: 466 - protein, 448 aa, Xenopus laevis
MPRKVSVAAWGAALFISWNAILLLYLMSRSRGTDHSDLTAHVIQLAEAAEAELEKQKGLLQQIHHYSGLLNQQQPSSHVRLAPLMPIKNLNVSSPFPSPVGSGPLPLVIPILVVACDRPSVRRCLDSLLKYRPSAEKFPIIVSQDCGHEETGKVIDSYGDAVTHIKQPDLSEVAVPPEHRKFQGYYKISRHYRWALNQIFKSMGYKAAIVVEDDLEVAPDFYEYFQATLPLLQKDRMLWCVSAWNDNGKEALIDPGGTSLLYRSDFFPGLGWLLLRELWEELEPKWPSAFWDDWVRRPEQRLDRACVRPELSRTRTFGRKGVSQGQFFDQHLRFIKLNQDLVRFTKMDLSYLLKDTYDPWFLEQVYGAPKARAEEVLHGQVPGGRTVRVEYTTKDTFKAMARAFGVMEDLKSGVARAAYKGVVSFSHRGRRVFLAPPKDWTGYDPLWT

SEQ ID NO: 467 - DNA, 1469 bp, Xenopus laevis
atggcgtcaacaaatgcgcgctatgtgcgctatctactaatcgccttcttcgtacgtcaccctacagactcgacacctctgtcccctatgcagttgttgctaacatagaagaatagacaatcctcgtcttctactttgtctccaattcaaagtatgagggcgtcgatctcaacaagggcaccttcacagctccggattcgaccaagacgacaccaaagccgccagccactggcgatgccaaagactttcctctggccctgacgccgaacgatccaggcttcaacgacctcgtcggcatcgctcccggccctcgaatgaacagcggcctgctcaaccagcagcagcccagctctcacgtccgcctcgcccccctcatgcccatcaagaacctcaacgtcagctcgcccttccccagccccgttggctctggccctctccccctcgtcatccccattctcgtcgtcgcctgcgaccgcccttctgtccgacgatgcctcgacagcctcctcaagtaccgccccagcgccgagaagttccccatcatcgtcagccaggactgcggccacgaggaaaccggcaaggtcatcgacagctacggcgacgccgtcacccacatcaagcagcccgacctcagcgaggtcgccgtccctcctgagcaccgcaagttccagggctactacaagatcagccgccactaccgctgggccctcaaccagatcttcaagagcatgggctacaaggccgccatcgtcgtcgaggacgacctcgaggttgcccccgacttctacgagtacttccaggccaccctgcccctgctccaaaaggaccgcatgctctggtgcgtcagcgcctggaacgacaacggcaaggaagccctcatcgaccctggcggcaccagcctgctctaccgcagcgacttctttcccggcctcggctggctcctcctgcgcgagctttgggaggaactcgagcccaagtggcccagcgccttctgggacgactgggtccgacgacctgagcagcgactcgaccgagcctgcgtccgacctgagctgtctcgcacccgcacctttggccgcaagggcgttagccagggccagttcttcgaccagcacctccgcttcatcaagctcaaccaggacctcgtccgcttcaccaagatggacctcagctacctcctcaaggacacctacgacccctggttcctcgagcaggtctacggcgctcctaaggcccgagccgaggaagtccttcacggccaggtccctggcggccgaactgtccgagtcgagtacaccaccaaggacaccttcaaggccatggcccgagccttcggcgtcatggaagatctcaagagcggcgtcgcccgagccgcctacaagggcgtcgtcagctttagccaccgcggacgccgcgtctttctcgcccctcctaaggactggaccggctacgaccccctctggacctaa

SEQ ID NO: 468 - protein, 467 aa, Xenopus laevis
MASTNARYVRYLLIAFFTILVFYFVSNSKYEGVDLNKGTFTAPDSTKTTPKPPATGDAKDFPLALTPNDPGFNDLVGIAPGPRMNSGLLNQQQPSSHVRLAPLMPIKNLNVSSPFPSPVGSGPLPLVIPILVVACDRPSVRRCLDSLLKYRPSAEKFPIIVSQDCGHEETGKVIDSYGDAVTHIKQPDLSEVAVPPEHRKFQGYYKISRHYRWALNQIFKSMGYKAAIVVEDDLEVAPDFYEYFQATLPLLQKDRMLWCVSAWNDNGKEALIDPGGTSLLYRSDFFPGLGWLLLRELWEELEPKWPSAFWDDWVRRPEQRLDRACVRPELSRTRTFGRKGVSQGQFFDQHLRFIKLNQDLVRFTKMDLSYLLKDTYDPWFLEQVYGAPKARAEEVLHGQVPGGRTVRVEYTTKDTFKAMARAFGVMEDLKSGVARAAYKGVVSFSHRGRRVFLAPPKDWTGYDPLWT

SEQ ID NO: 469 - DNA, 1371 bp, Drosophila melanogaster
atgcgaacccgcaaggtcctcctcgtcatcggctttctcgtcacctggacctacgccacctactacctgctcctccgccagaccggcatccacacctctcgccaccagagcctccaggcctacaagctcaacagccaggcccgcgacgccaacatgcagagccaccacctcgccaagaacgtctttgagttcgtcaagctcaagtacctcgagaagcagccccccagcgtcgccagcaccccccagatcagcatcattgccgccgagatcagcgccgagctgcccgagcagcacgtcgccaagtctgccaccgcccgcatccccaccaagacctacctcgccaacggcgagcccgtctttcccgtcgtcgtctttgcctgcaaccgcgtcagcgtcaagaagtgcatcgacaacctcgtccagtaccgccccagcgtcgagcagttccccatcatcgtcagccaggactgcggcgacgagcccaccaaggaagccatcctcagctacggcaagcaggtcaccctcatcgagcagcccgacctcagcgacatcatgcccaaggaaaagaagttcaagggctactacaagatcgcccgccactacggctgggccctcaacaccactttcgccgtcggcttcgagttcgtcatcatcgtcgaggacgacctcaacgtcgcccccgacttcttcgagtacttcctcggcacccacaagctcctcaagcaggaccccagcctctggtgcgtcagcgcctggaacgacaacggcaaggccgccgtcgtcgatgccgctcagcctgagctgctctaccgcaccgactttttccccggcctcggctggatgctcaccaaggacctctgggccgagctgagcgtcaagtggcccaagagcttctgggacgactggatccgccaccccgcccagcgaaaggaccgcgtctgcatccgccccgagattagccgcacccgcaccttcggcaagatcggcgtcagcaacggcctgttcttcgacaagtacctcaagcacatcaagctcagcgaggacttcgtccagttcaccaagatcaacatgagctacctgctcaaggacaactacgacaacaccttcctccgccgcgtctacacctaccccatcgtcacctacgacgagctgcgccgcaacctcatccgcatcgagggccccgtccgcatccagtacaccacccgcgagcagtacaagcgcaccaccaagatgctcggcctcatggacgacttcaagagcggcgtcccccgcaccgcctaccacggcatcgtcagcttctactacaacaagcgccgcgtccacctcgcccccaacgccaactggaagggctacgagctgagctggtcctaa

SEQ ID NO: 470 - protein, 456 aa, Drosophila melanogaster
MRTRKVLLVIGFLVTWTYATYYLLLRQTGIHTSRHQSLQAYKLNSQARDANMQSHHLAKNVFEFVKLKYLEKQPPSVASTPQISIIAAEISAELPEQHVAKSATARIPTKTYLANGEPVFPVVVFACNRVSVKKCIDNLVQYRPSVEQFPIIVSQDCGDEPTKEAILSYGKQVTLIEQPDLSDIMPKEKKFKGYYKIARHYGWALNTTFAVGFEFVIIVEDDLNVAPDFFEYFLGTHKLLKQDPSLWCVSAWNDNGKAAVVDAAQPELLYRTDFFPGLGWMLTKDLWAELSVKWPKSFWDDWIRHPAQRKDRVCIRPEISRTRTFGKIGVSNGLFFDKYLKHIKLSEDFVQFTKINMSYLLKDNYDNTFLRRVYTYPIVTYDELRRNLIRIEGPVRIQYTTREQYKRTTKMLGLMDDFKSGVPRTAYHGIVSFYYNKRRVHLAPNANWKGYELSWS

SEQ ID NO: 471 - DNA, 1335 bp, Arabidopsis thaliana
atggcccgcatctcttgcgacctccgcttcctcctcatccctgccgccttcatgttcatctacatccagatgcgcctcttccagacccagagccagtacgccgaccgcctcagcagcgccatcgagagcgagaaccactgcaccagccagatgcgcggcctcatcgacgaggtcagcatcaagcagagccgcatcgtcgccctcgaggacatgaagaaccgccaggacgaggaactcgtccagctcaaggacctcatccagaccttcgagaagaagggcattgccaagctcacccagggcggccagatgcctgtcgccgctgtcgtcgtcatggcctgctctcgcgccgactacctcgagcgcaccgtcaagagcgtcctcacctaccagacccccgtcgccagcaagtaccccctgttcatcagccaggacggcagcgaccaggccgtcaagagcaagagcctcagctacaaccagctcacctacatgcagcacctcgacttcgagcccgtcgtcaccgagcgacctggcgagctgaccgcctactacaagatcgcccgccactacaagtgggccctcgaccagctgttctacaagcacaagttcagccgcgtcatcatcctcgaggacgacatggaaatcgcccccgacttcttcgactacttcgaggccgctgccagcctcatggaccgcgacaagaccatcatggccgccagcagctggaacgacaacggccagaagcagttcgtccacgacccctacgccctctaccgcagcgacttctttcccggcctcggctggatgctcaagcgcagcacttgggacgagctgagccccaagtggcccaaggcctactgggacgactggctccgcctcaaggaaaaccacaagggccgccagttcatccgccccgaggtctgccgcacctacaacttcggcgagcacggcagcagcctcggccagttcttcagccagtacctcgagcccatcaagctcaacgacgtcaccgtcgactggaaggccaaggacctcggctacctcaccgagggcaactacaccaagtacttcagcggcctcgtccgccaggcccgacccattcagggctctgacctcgtcctcaaggcccagaacatcaaggacgacgtccgcatccgctacaaggaccaggtcgagttcgagcgcattgccggcgagttcggcatcttcgaggaatggaaggacggcgtcccccgcaccgcctacaagggcgtcgtcgtctttcgcatccagaccacccgccgagtctttctcgtcggccccgacagcgtcatgcagctcggcatccgcaacagctaa

SEQ ID NO: 472 - protein, 444 aa, Arabidopsis thaliana
MARISCDLRFLLIPAAFMFIYIQMRLFQTQSQYADRLSSAIESENHCTSQMRGLIDEVSIKQSRIVALEDMKNRQDEELVQLKDLIQTFEKKGIAKLTQGGQMPVAAVVVMACSRADYLERTVKSVLTYQTPVASKYPLFISQDGSDQAVKSKSLSYNQLTYMQHLDFEPVVTERPGELTAYYKIARHYKWALDQLFYKHKFSRVIILEDDMEIAPDFFDYFEAAASLMDRDKTIMAASSWNDNGQKQFVHDPYALYRSDFFPGLGWMLKRSTWDELSPKWPKAYWDDWLRLKENHKGRQFIRPEVCRTYNFGEHGSSLGQFFSQYLEPIKLNDVTVDWKAKDLGYLTEGNYTKYFSGLVRQARPIQGSDLVLKAQNIKDDVRIRYKDQVEFERIAGEFGIFEEWKDGVPRTAYKGVVVFRIQTTRRVFLVGPDSVMQLGIRNS

SEQ ID NO: 473 - DNA, 1404 bp, Caenorhabditis elegans
atgaagcgcgtcctccgccgcagcgcctctaagcacgccagcaccctcttcaagatcatctgcatcctcgtcctctgcagcttcatcatctacctcaagagcgaggaccacgacctccagaagaacaccgccatccacgcccctcgcagcaacagccgcgaggacgaggacgacatcctcatccccgccgacaacaaggaccagcagttcgtcgccgccgtcctcgtcttttgcgccacccgacctgacgccctccgcaaccacctcagccagattctcgcccagcgccccagccacttccagtaccacatcatcgtcagccaggacggcaacaagaccgccgtcacccaggtcgcccagaagttcgtcaaggactacaagaacgtcagccacatccagcacgaaaagaccgagatcaagaagcgcaacaactaccccgccatcagcgcccactacaagtgggccctcgacaaggccttcaagggcttccgctacgaccacgtcattgtcaccgaggacgacctcgacatcggcaacgactttttcagctacttccgctggggcaagcaggtcctcaacagcgacgacaccatctggtgcgtcagcgcctggaacgacaacggcggaggccccctcatcgacagcactcgcggcgacctgatctggcgcaccgacttttttcccggcctcggctggatgctcaccaagaagctctggaacgagctgagccccggcttccccgtcgcctactgggacgactggatgcgcaagcccgaggtccgcaagagccgcagctgcatccgccccgagattagccgcaccagccacaacatgaagctcgccggcaagggcagcagcggcggcatgttcaaggactacctcagcaagatcagcgccagcagcgccaacatcgacttcagcctgctccccgtcaccctcgtccagaagtccatctacgacaagcgcctcatcgagcagatcgagaacgcccgacccatcgacctgcagaacaccaccggcatggaaaagacctacaactacaagatcgtctacaagaacatccgcgactggcaccgcctcgccgcccacttcaagctcatgaccgacatccgaggcggcatgcagcgcaccgcctactacggcgtcgtcaccctcatgttccagaactgccgcgtctttctcgtccccgagagcacctaccgcaaccccagccagctcaccagctacgtctacgacagcgagtgggacaagcagaaccgcttcatcgagttcgaggcctactactgcaagaccaagaagtacgccggcaagtgcgacccccacagccccgagatgatcgccttcttcaagaagaagggctggaagaagcgcctcgacgactggggcgagatgctcgtcgtctaa

SEQ ID NO: 474 - protein, 467 aa, Caenorhabditis elegans
MKRVLRRSASKHASTLFKIICILVLCSFIIYLKSEDHDLQKNTAIHAPRSNSREDEDDILIPADNKDQQFVAAVLVFCATRPDALRNHLSQILAQRPSHFQYHIIVSQDGNKTAVTQVAQKFVKDYKNVSHIQHEKTEIKKRNNYPAISAHYKWALDKAFKGFRYDHVIVTEDDLDIGNDFFSYFRWGKQVLNSDDTIWCVSAWNDNGGGPLIDSTRGDLIWRTDFFPGLGWMLTKKLWNELSPGFPVAYWDDWMRKPEVRKSRSCIRPEISRTSHNMKLAGKGSSGGMFKDYLSKISASSANIDFSLLPVTLVQKSIYDKRLIEQIENARPIDLQNTTGMEKTYNYKIVYKNIRDWHRLAAHFKLMTDIRGGMQRTAYYGVVTLMFQNCRVFLVPESTYRNPSQLTSYVYDSEWDKQNRFIEFEAYYCKTKKYAGKCDPHSPEMIAFFKKKGWKKRLDDWGEMLVV

SEQ ID NO: 475 - DNA, 1332 bp, Spodoptera frugiperda
atgcgcctcaacgtcaagaaggccctcatcttcgtcggctgcgtcgtctttctctgggtcctcctcagctacgccagcgtcatcgaggtccctcgcgccgtccctcagaaggaccccgccgtcgagatcgagaagaagatcatcaagctccagaagcaggtcgacgcccagatggccgagagcaagagcctcctcgccaaggtcaagaagctcaagaagatcagcgagggcgagaacgtcggcggcgaagaggacagcctcaaggacagcgaggtcatgcagcacctcagccagcccatcctccccgtcctcgtcattgcctgcgaccgcgtcactgtccagcgctgcctcgacaacctcgtcaagttccgccccagcaaggaaaccttccccatcatcgtcagccaggactgcggccacaacgccacctacgaggtcatcaccagctacaccgccagcgaccccaccatcagcgtcgtccgacagcccgacctcagcgagattgtcctgccccgcgtcaaggtcaagtttcgcggctactacaagatcgcccgccactacaagttcgccctcaaccacgtctttgagactctcggccacgaggccgtcatcatcgtcgaggacgacctcgacatcagccccgactttttcgagtacttcctcggcacctaccccctgctcctcaaggaccccagcctctggtgcatcagcgcctggaacgacaacggcaagatggaagtcatcgatatgagccgccctgacctcctccaccgcaccgacttttttcccggcctcggctgggtcctccgccgcgagatgtggcgaaagctcgcccccaagtggcccaccgcctttttcgacgactggctccgcaaccccgtcaacatcgacggcaaggcctgcatccgccccgagatcagccgcacctacagcttcggcaaggtcggcgtcagcaagggcctcttcttcgacctccacctccgcaacatccagctcaacatggaatacgtcgagttcaccaagctcaacctcacctacctgctcaaggaacactacgacgacgccctcgtcagcaccgtctacaacctccccgagatgagcgccagcgaggtcgtcgctggctctgacctctctgccgaccccgtccgcgtcatgtacagcaacgccaagacctaccagcgagccgccaagaagctcggcctcatggacgacttccgcagcggcgtccctcgcactgcctaccgcggcatcgtcacgtgcttcatccgaggccgccgagtctacctcgcccccagcttcgagtggaacaagtacgaccccacctggggctaa

SEQ ID NO: 476 - protein, 443 aa, Spodoptera frugiperda
MRLNVKKALIFVGCVVFLWVLLSYASVIEVPRAVPQKDPAVEIEKKIIKLQKQVDAQMAESKSLLAKVKKLKKISEGENVGGEEDSLKDSEVMQHLSQPILPVLVIACDRVTVQRCLDNLVKFRPSKETFPIIVSQDCGHNATYEVITSYTASDPTISVVRQPDLSEIVLPRVKVKFRGYYKIARHYKFALNHVFETLGHEAVIIVEDDLDISPDFFEYFLGTYPLLLKDPSLWCISAWNDNGKMEVIDMSRPDLLHRTDFFPGLGWVLRREMWRKLAPKWPTAFFDDWLRNPVNIDGKACIRPEISRTYSFGKVGVSKGLFFDLHLRNIQLNMEYVEFTKLNLTYLLKEHYDDALVSTVYNLPEMSASEVVAGSDLSADPVRVMYSNAKTYQRAAKKLGLMDDFRSGVPRTAYRGIVTCFIRGRRVYLAPSFEWNKYDPTWG

SEQ ID NO: 477 - DNA, 1335 bp, Phaeodactylum tricornutum
atgcgcctctggaagcgcaccacctctggcgtccctccccctcgtcgacgacgtcgaggcggccgagaggaacgcctcgctattggcctcctcctcaccctcgctgtcgtctggggcactgtcctcgtcggcaccctcgtcgctctggtcgccagccctaccaagagcgtccccacctttcccaccgtccccaccgactctcgacccagcgccgcctttgtcgtcagcgacgctcctggcgcctacgagagccccctcctcgtctttacctgccgacgcgaccagtacctccgcgagactctccgcgacatctggaactacatccccacggactgcagcgtcggctgccccctcgtcattagccaggacggcaacgaccctgccgtccgccgagtcgtccgcgagttcaccgacgagttcgccaccaagaacgtccccgtcatccactggacccacacctctgccctccgcggcagcaccaacggctaccaggccctcgccatccactacggctgggccctccgccgagtctttgacggccagactctcagcggcagcgtccacggcgctaagcacggcactccccagcgcgtcatcatcctcgaagaggacctccacgtcgcccccgactttttcgactacttcgccgccaccgcccctctgctcgaccacgattctagcctgctcgccgtcagcgccttccacgacaacggcttcgcccacaacgtccgcaacgccagccgaatcctccgcagcgacttcttccctggcctcggctggatgatgaaccgccgcctctgggtcgacgagctgcagagcaagtggcctggcggctactgggacgactggctccgagagcctgcccagcgacaggaccgcgccattctccgccctgagatcagccgcacctaccacttcggcaccgagggcggcaccagcagcaaccagtttggcagccacctcagcaagatcctgctcaaccgcgagactgtcgactggtccaaggccgccgatctcgaggcccagctccgacccgaggtctacgaccctgcctactgggccatggtccaggccagcaccctcacctacaccatccccgacgccctcgagcaggccaagaagtccaacgcccgcctccagtacaccaccatcgagcagttcaagtacctcgcccacaagctcaagctcatggccgacgagaaggccaacgtcccccgcaccgcctacaagggcatcgtcgagactcgaccccacggcgccgactactttctcttcctgacgccccctctggccgagctgcagaaggaattcgacatccccagccccaagcgctaa

SEQ ID NO: 478 - DNA, 320 bp, Trichoderma reesei
atggcgtcaacaaatgcgcgctatgtgcgctatctactaatcgccttcttcgtacgtcaccctacagactcgacacctctgtcccctatgcagttgttgctaacatagaagaatagacaatcctcgtcttctactttgtctccaattcaaagtatgagggcgtcgatctcaacaagggcaccttcacagctccggattcgaccaagacgacaccaaagccgccagccactggcgatgccaaagactttcctctggccctgacgccgaacgatccaggcttcaacgacctcgtcggcatcgctcccggccctcgaatgaac

SEQ ID NO: 479 - protein, 85 aa, Trichoderma reesei; identical to SEQ ID NO: 208

SEQ ID NO: 480 - protein, 407 aa, Homo sapiens
SVSALDGDPASLTREVIRLAQDAEVELERQRGLLQQIGDALSSQRGRVPTAAPPAQPRVPVTPAPAVIPILVIACDRSTVRRCLDKLLHYRPSAELFPIIVSQDCGHEETAQAIASYGSAVTHIRQPDLSSIAVPPDHRKFQGYYKIARHYRWALGQVFRQFRFPAAVVVEDDLEVAPDFFEYFRATYPLLKADPSLWCVSAWNDNGKEQMVDASRPELLYRTDFFPGLGWLLLAELWAELEPKWPKAFWDDWMRRPEQRQGRACIRPEISRTMTFGRKGVSHGQFFDQHLKFIKLNQQFVHFTQLDLSYLQREAYDRDFLARVYGAPQLQVEKVRTNDRKELGEVRVQYTGRDSFKAFAKALGVMDDLKSGVPRAGYRGIVTFQFRGRRVHLAPPPTWEGYDPSWN

SEQ ID NO: 481 - DNA, 1224 bp, Homo sapiens
tcagtcagcgctctcgatggcgaccccgccagcctcacccgggaagtgattcgcctggcccaagacgccgaggtggagctggagcggcagcgtgggctgctgcagcagatcggggatgccctgtcgagccagcgggggagggtgcccaccgccgcccctcccgcccagccgcgtgtgcctgtgacccccgcgccggcggtgattcccatcctggtcatcgcctgtgaccgcagcactgttcggcgctgcctggacaagctgctgcattatcggccctcggctgagctcttccccatcatcgtcagccaggactgcgggcacgaggagacggcccaggccatcgcctcctacggcagcgcggtcacgcacatccggcagcccgacctgagcagcattgcggtgccgccggaccaccgcaagttccagggctactacaagatcgcgcgccactaccgctgggcgctgggccaggtcttccggcagtttcgcttccccgccgccgtggtggtggaggatgacctggaggtggccccggacttcttcgagtactttcgggccacctatccgctgctgaaggccgacccctccctgtggtgcgtctcggcctggaatgacaacggcaaggagcagatggtggacgccagcaggcctgagctgctctaccgcaccgactttttccctggcctgggctggctgctgttggccgagctctgggctgagctggagcccaagtggccaaaggccttctgggacgactggatgcggcggccggagcagcggcaggggcgggcctgcatccgccctgagatctcaagaacgatgacctttggccgcaagggtgtgagccacgggcagttctttgaccagcacctcaagttcatcaagctgaaccagcagtttgtgcacttcacccagctggacctgtcttacctgcagcgggaggcctatgaccgagatttcctcgcccgcgtctacggtgctccccagctgcaggtggagaaagtgaggaccaatgaccggaaggagctgggggaggtgcgggtgcagtacacgggcagggacagcttcaaggctttcgccaaggctctgggtgtcatggatgacctcaagtcgggggttccgagagctggctaccggggcattgtcaccttccagttccggggccgccgtgtccacctggcgcccccaccgacgtgggagggctatgatcccagctggaattag

SEQ ID NO: 482 - protein, 58 aa, Homo sapiens
MRFRIYKRKVLILTLVVAACGFVLWSSNGRQRKNEALAPPLLDAEPARGAGGRGGDHP

SEQ ID NO: 483 - DNA, 174 bp, Homo sapiens
atgcgcttccgaatctacaagcggaaggtcctcattctgacccttgtcgtggccgcttgcggctttgttctctggtccagcaacggtcgccagcgtaagaacgaggccctggcgcctcccctcttggacgccgaaccggccagaggcgcaggtggcaggggaggggatcacccc

SEQ ID NO: 484 - DNA, 1344 bp, Homo sapiens
atgcgcttccgaatctacaagcggaaggtcctcattctgacccttgtcgtggccgcttgcggctttgttctctggtccagcaacggtcgccagcgtaagaacgaggccctggcgcctcccctcttggacgccgaaccggccagaggcgcaggtggcaggggaggggatcacccctcggtcgctgtcggcatccgccgcgtcagcaatgtgtccgccgcctctctggtcccggcggttccgcagcctgaggcagacaacctcacgctgcgctaccgatcactcgtgtatcaacttaacttcgaccagactctgcggaacgtcgacaaggccggaacctgggctccgcgtgagttggtcctcgtcgttcaggtgcacaacaggcccgagtacctccgcctcctgctggattcgcttcgaaaggcccagggcatcgacaacgtcctggtgattttcagccatgacttttggtccacagagatcaatcagctcattgcgggtgtcaacttttgccccgtcttgcaagttttcttccctttctctatccaactctaccccaacgagttcccgggcagtgacccccgcgactgtcctcgggatctgccaaaaaacgccgctctcaagctgggctgcatcaacgccgaataccccgacagctttggccactatcgcgaggccaagttctcgcagacgaagcaccactggtggtggaagctccattttgtctgggagcgagtgaagatccttcgtgattacgcaggactcattctgttcttggaagaggaccactacctggccccggacttctaccacgtctttaagaagatgtggaagctcaagcagcaggaatgccccgagtgcgacgttctgtcccttggcacctatagcgcgtcccgctcgttctacggtatggctgacaaggtcgatgtgaaaacctggaagtcaactgagcacaatatgggcctcgccctgacgaggaacgcctaccagaaactcatcgagtgtaccgacaccttctgcacgtacgacgactataactgggattggacactgcagtacttgactgtcagctgcctccctaagttttggaaggtccttgttccccagatcccgagaattttccatgctggcgactgcgggatgcaccacaagaaaacctgtcgcccatccacgcagtctgcccaaatcgagtcgctcctgaacaacaacaagcagtacatgttccccgagacactgaccattagcgagaagtttacggtcgtggcgatctccccgcctcgaaagaatggcggctggggtgacatccgcgatcacgagctgtgcaagtcttaccgccggctccagtaa

SEQ ID NO: 485 - DNA, 20 bp, Artificial Sequence
  PRIMER
cctggaaagcactgttggag

SEQ ID NO: 486 - DNA, 20 bp, Artificial Sequence
  PRIMER
gattgtcatggtgtacgtga

SEQ ID NO: 487 - DNA, 19 bp, Artificial Sequence
  PRIMER
catcctcaaggcctcagac

SEQ ID NO: 488 - DNA, 57 bp, Artificial Sequence
  PRIMER
gtaacgccagggttttcccagtcacgacggtttaaacgttgggctgaggccgtatcg

SEQ ID NO: 489 - DNA, 68 bp, Artificial Sequence
  PRIMER
ttcttcttattgatttgagcctgtgtgtagagatacaaggggccggccgagagaggcaactcaggtga

SEQ ID NO: 490 - DNA, 24 bp, Artificial Sequence
  PRIMER
ccttgtatctctacacacaggctc

SEQ ID NO: 491 - DNA, 20 bp, Artificial Sequence
  PRIMER
ctgatgtctgctcaagcggg

SEQ ID NO: 492 - DNA, 68 bp, Artificial Sequence
  PRIMER
gcagcttgactaacagctaccccgcttgagcagacatcagttaattaaaggctgcggactactgaatc

SEQ ID NO: 493 - DNA, 71 bp, Artificial Sequence
  PRIMER
cgtcaagctgtttgatgatttcagtaacgttaagtggatcttaattaacctattctacgtacagcatgcaa

SEQ ID NO: 494 - DNA, 26 bp, Artificial Sequence
  PRIMER
gatccacttaacgttactgaaatcat

SEQ ID NO: 495 - DNA, 84 bp, Artificial Sequence
  PRIMER
gccaagcccaaaaagtgctccttcaatatcatcttctgtcgcggccgcgcgatcgcggccggccgagtggagatgtggagtggg

SEQ ID NO: 496 - DNA, 68 bp, Artificial Sequence
  PRIMER
cccgtcaccgagatctgatccgtcaccgggatccacttaagcggccgcgggcagtatgccggatggct

SEQ ID NO: 497 - DNA, 57 bp, Artificial Sequence
  PRIMER
gcggataacaatttcacacaggaaacagcgtttaaacatctggccgagtaccaccac

SEQ ID NO: 498 - DNA, 68 bp, Artificial Sequence
  PRIMER
gattaagttgggtaacgccagggttttcccagtcacgacggtttaaacgacctacccagtctcactac

SEQ ID NO: 499 - DNA, 68 bp, Artificial Sequence
  PRIMER
ttcttcttattgatttgagcctgtgtgtagagatacaaggggccggccggtcctcggctacgttgtca

SEQ ID NO: 500 - DNA, 20 bp, Artificial Sequence
  PRIMER
cctcgtgtactgtgtaagcg

SEQ ID NO: 501 - DNA, 20 bp, Artificial Sequence
  PRIMER
tggaattgtgagcggataac

SEQ ID NO: 502 - DNA, 21 bp, Artificial Sequence
  PRIMER
cctatgagtcgtttacccaga

SEQ ID NO: 503 - DNA, 20 bp, Artificial Sequence
  PRIMER
atgatgactccaggccaaag

SEQ ID NO: 504 - DNA, 20 bp, Artificial Sequence
  PRIMER
tgacgtaccagttgggatga

SEQ ID NO: 505 - DNA, 64 bp, Artificial Sequence
  PRIMER
taagttgggtaacgccagggttttcccagtcacgacgtttaaaccaagtcttcgtactctatcg

SEQ ID NO: 506 - DNA, 20 bp, Artificial Sequence
  PRIMER
gatgattatttgtgcgtgtt

SEQ ID NO: 507 - DNA, 60 bp, Artificial Sequence
  PRIMER
tatcgacttcaaggaaaacacgcacaaataatcatcggtctgaaggacgtggaatgatgg

SEQ ID NO: 508 - DNA, 26 bp, Artificial Sequence
  PRIMER
gttgagagaagttgttggattgatca

SEQ ID NO: 509 - DNA, 68 bp, Artificial Sequence
  PRIMER
caaccaaagactttttgatcaatccaacaacttctctcaacttaattaaatgtatcggaagttggccg

SEQ ID NO: 510 - DNA, 69 bp, Artificial Sequence
  PRIMER
agatacaaacgttggcgaggcttctgcattcagctcagagtgggccggcctcacttcttgaggacgatg

SEQ ID NO: 511 - DNA, 40 bp, Artificial Sequence
  PRIMER
ggccggcccactctgagctgaatgcagaagcctcgccaac

SEQ ID NO: 512 - DNA, 27 bp, Artificial Sequence
  PRIMER
tacaataacacagatcttttatgacgg

SEQ ID NO: 513 - DNA, 68 bp, Artificial Sequence
  PRIMER
gtaatgttctaccgtcataaaagatctgtgttattgtagcgatcgcctagcatcgactactgctgctc

SEQ ID NO: 514 - DNA, 66 bp, Artificial Sequence
  PRIMER
gcggataacaatttcacacaggaaacagcgtttaaacgcggccgcctccaccgaccgatccgttgg

SEQ ID NO: 515 - DNA, 67 bp, Artificial Sequence
  PRIMER
gtaacgccagggttttcccagtcacgacggtttaaacgcggccgctcaagctcatggacctcaaggc

SEQ ID NO: 516 - DNA, 24 bp, Artificial Sequence
  PRIMER
ccatgcaaagatacacatcaatcg

SEQ ID NO: 517 - DNA, 70 bp, Artificial Sequence
  PRIMER
gattgtaccccagctgcgattgatgtgtatctttgcatgggcggccgcggcatccgtagttgtcgcaaga

SEQ ID NO: 518 - DNA, 26 bp, Artificial Sequence
  PRIMER
gttgagagaagttgttggattgatca

SEQ ID NO: 519 - DNA, 60 bp, Artificial Sequence
  PRIMER
aaccaaagactttttgatcaatccaacaacttctctcaacatgagattccctagcagctc

SEQ ID NO: 520 - DNA, 75 bp, Artificial Sequence
  PRIMER
cgtcaagctgtttgatgatttcagtaacgttaagtggatcttagagctcgtcgtgagcaaggtggccgccccgtc

SEQ ID NO: 521 - DNA, 46 bp, Artificial Sequence
  PRIMER
gatccacttaacgttactgaaatcatcaaacagcttgacgaatctg

SEQ ID NO: 522 - DNA, 67 bp, Artificial Sequence
  PRIMER
tcactaaccaccccaatactacataccagctcaaacccctggccggccgagtggagatgtggagtgg

SEQ ID NO: 523 - DNA, 59 bp, Artificial Sequence
  PRIMER
cactcggccggccaggggtttgagctggtatgtagtattggggtggttagtgagttaac

SEQ ID NO: 524 - DNA, 64 bp, Artificial Sequence
  PRIMER
attgtgagcggataacaatttcacacaggaaacagcgtttaaactctcggcgcttgtcaatgtt

SEQ ID NO: 525 - DNA, 33 bp, Artificial Sequence
  PRIMER
atgttgagagaagttgttggattgatcaaaaag

SEQ ID NO: 526 - DNA, 20 bp, Artificial Sequence
  PRIMER
ccgcgttgaacggcttccca

SEQ ID NO: 527 - DNA, 20 bp, Artificial Sequence
  PRIMER
gaatccgctcttggctccac

SEQ ID NO: 528 - DNA, 20 bp, Artificial Sequence
  PRIMER
gcgacggcgacccattagca

SEQ ID NO: 529 - DNA, 20 bp, Artificial Sequence
  PRIMER
tgcgctctcaccagcatcgc

SEQ ID NO: 530 - DNA, 20 bp, Artificial Sequence
  PRIMER
ccactccaagtcaacatcaa

SEQ ID NO: 531 - DNA, 57 bp, Artificial Sequence; identical to SEQ ID NO: 488
  PRIMER

SEQ ID NO: 532 - DNA, 77 bp, Artificial Sequence
  PRIMER
tggtgtttgaatagattgtctctggcctcttgttgccacaggccggccgcgatcgcgagagaggcaactcaggtgag

SEQ ID NO: 533 - DNA, 21 bp, Artificial Sequence
  PRIMER
tgtggcaacaagaggccagag

SEQ ID NO: 534 - DNA, 20 bp, Artificial Sequence
  PRIMER
gatgcgcagtccgcggttga

SEQ ID NO: 535 - DNA, 63 bp, Artificial Sequence
  PRIMER
gaggcacagaaacccaatagtcaaccgcggactgcgcatcatgtccaaccgttggaccctact

SEQ ID NO: 536 - DNA, 39 bp, Artificial Sequence
  PRIMER
ctacagctcgtcgtgaaactcaatccgccatgtctttcc

SEQ ID NO: 537 - DNA, 61 bp, Artificial Sequence
  PRIMER
tggaaagacatggcggattgagtttcacgacgagctgtagggctttcgtgaccgggcttca

SEQ ID NO: 538 - DNA, 88 bp, Artificial Sequence
  PRIMER
gccgcagcctcagcctctctcagcctcatcagccgcggccgcgcgatcgcttaattaaggccggccgtatcagtcagcgagcaagcca

SEQ ID NO: 539 - DNA, 65 bp, Artificial Sequence
  PRIMER
gctggcaacgagagcagagcagcagtagtcgatgctaggcggccgcgggcagtatgccggatggc

SEQ ID NO: 540 - DNA, 57 bp, Artificial Sequence; identical to SEQ ID NO: 497
  PRIMER

SEQ ID NO: 541 - DNA, 64 bp, Artificial Sequence; identical to SEQ ID NO: 505
  PRIMER

SEQ ID NO: 542 - DNA, 80 bp, Artificial Sequence
  PRIMER
tggtgtttgaatagattgtctctggcctcttgttgccacaggccggccgcgatcgcgatgattatttgtgcgtgttttcc

SEQ ID NO: 543 - DNA, 68 bp, Artificial Sequence
  PRIMER
gctggcaacgagagcagagcagcagtagtcgatgctaggcggccgcaggggtttgagctggtatgtag

SEQ ID NO: 544 - DNA, 64 bp, Artificial Sequence; identical to SEQ ID NO: 524
  PRIMER

SEQ ID NO: 545 - DNA, 77 bp, Artificial Sequence
  PRIMER
ttattcacactctcagaataaattcatcgccaatttgacaggccggccttaattaatgtggcaacaagaggccagag

SEQ ID NO: 546 - DNA, 20 bp, Artificial Sequence
  PRIMER
gatgcgcagtccgcggttga

SEQ ID NO: 547 - DNA, 64 bp, Artificial Sequence
  PRIMER
gaggcacagaaacccaatagtcaaccgcggactgcgcatcatgatacttcctcagggatcgctc

SEQ ID NO: 548 - DNA, 23 bp, Artificial Sequence
  PRIMER
tcacagctcatccttgcggttcg

SEQ ID NO: 549 - DNA, 62 bp, Artificial Sequence
  PRIMER
tgagggcgcaactgccccgaaccgcaaggatgagctgtgacactctgagctgaatgcagaag

SEQ ID NO: 550 - DNA, 70 bp, Artificial Sequence
  PRIMER#
ataccgccgcactggccgtagtgagactgggtaggtcttaattaatacaataacacagatcttttatgac

SEQ ID NO: 551 - DNA, 83 bp, Artificial Sequence
  PRIMER
agaaatggcttgctcgctgactgatacggccggccttaattaatgtggcaacaagaggccagagacaatctattcaaacacca

SEQ ID NO: 552 - DNA, 83 bp, Artificial Sequence
  PRIMER
tggtgtttgaatagattgtctctggcctcttgttgccacattaattaaggccggccgtatcagtcagcgagcaagccatttct

SEQ ID NO: 553 - DNA, 86 bp, Artificial Sequence
  PRIMER
gtaatgttctaccgtcataaaagatctgtgttattgtattaattaagcgatcgcgcggccgcggctgatgaggctgagagaggctg

SEQ ID NO: 554 - DNA, 86 bp, Artificial Sequence
  PRIMER
cagcctctctcagcctcatcagccgcggccgcgcgatcgcttaattaatacaataacacagatcttttatgacggtagaacattac

SEQ ID NO: 555 - DNA, 20 bp, Artificial Sequence
  PRIMER
ggcgaaagggggatgtgctg

SEQ ID NO: 556 - DNA, 20 bp, Artificial Sequence
  PRIMER
cactttatgcttccggctcc

SEQ ID NO: 557 - DNA, 19 bp, Artificial Sequence
  PRIMER
catcttttgaggcacagaa

SEQ ID NO: 558 - DNA, 21 bp, Artificial Sequence
  PRIMER
tcatgatacgggctcaccaag

SEQ ID NO: 559 - DNA, 20 bp, Artificial Sequence
  PRIMER
gcgatggtgtggttcccggt

SEQ ID NO: 560 - DNA, 20 bp, Artificial Sequence
  PRIMER
cagctgcggagcatgagcct

SEQ ID NO: 561 - DNA, 20 bp, Artificial Sequence
  PRIMER
ccggcaactcagacctacag

SEQ ID NO: 562 - DNA, 24 bp, Artificial Sequence
  PRIMER
tgtaactcaggttaattgttgggc

SEQ ID NO: 563 - DNA, 17 bp, Artificial Sequence
  PRIMER
ggagcatgagcctatgg

SEQ ID NO: 564 - DNA, 20 bp, Artificial Sequence
  PRIMER#
caaccgttggaccctactgc

SEQ ID NO: 565 - DNA, 22 bp, Artificial Sequence
  PRIMER
cctttagcgccgacttcaagag

SEQ ID NO: 566 - DNA, 20 bp, Artificial Sequence
  PRIMER
caccactgacacccagagtc

SEQ ID NO: 567 - DNA, 20 bp, Artificial Sequence
  PRIMER
gccatcaaatggtgggtcag

SEQ ID NO: 568 - DNA, 20 bp, Artificial Sequence
  PRIMER
gagagccgtatctgattgcc

SEQ ID NO: 569 - DNA, 20 bp, Artificial Sequence
  PRIMER
gagacgttcgactataagcg

SEQ ID NO: 570 - DNA, 21 bp, Artificial Sequence
  PRIMER
atgatacttcctcagggatcg

SEQ ID NO: 571 - DNA, 20 bp, Artificial Sequence
  PRIMER
ggagaagagacagaagtcca

SEQ ID NO: 572 - DNA, 20 bp, Artificial Sequence
  PRIMER
cgggcatcaactgggaacag

SEQ ID NO: 573 - DNA, 22 bp, Artificial Sequence
  PRIMER
gtcactcttcagtacgccaacg

SEQ ID NO: 574 - DNA, 20 bp, Artificial Sequence
  PRIMER
tacgagccgctttcaacctc

SEQ ID NO: 575 - DNA, 24 bp, Artificial Sequence
  PRIMER
ggctactttagttacatgacagca

SEQ ID NO: 576 - DNA, 20 bp, Artificial Sequence
  PRIMER
tttcacgcgcatcttcatcg

SEQ ID NO: 577 - DNA, 20 bp, Artificial Sequence
  PRIMER
tccaatgtgggaaagctgcc

SEQ ID NO: 578 - DNA, 22 bp, Artificial Sequence
  PRIMER
ggatgagtcgagttcgtatggg

SEQ ID NO: 579 - DNA, 21 bp, Artificial Sequence
  PRIMER
cagtaatcatcgttcacggcg

SEQ ID NO: 580 - DNA, 20 bp, Artificial Sequence
  PRIMER
gaagggaatcacgaagagcc

SEQ ID NO: 581 - DNA, 19 bp, Artificial Sequence
  PRIMER
aaaccgcgaccttgagacc

SEQ ID NO: 582 - DNA, 24 bp, Artificial Sequence
  PRIMER
cgagagtgtgggattggatatcac

SEQ ID NO: 583 - DNA, 22 bp, Artificial Sequence
  PRIMER#
gcaccaagtgtgaagacaagtg

SEQ ID NO: 584 - DNA, 24 bp, Artificial Sequence
  PRIMER
tggaatacaaccctaacttcaacg

SEQ ID NO: 585 - DNA, 23 bp, Artificial Sequence
  PRIMER
gcaaagccccacttccccacgtt

SEQ ID NO: 586 - DNA, 22 bp, Artificial Sequence
  PRIMER
caactcagatcctccaggagac

SEQ ID NO: 587 - DNA, 20 bp, Artificial Sequence
  PRIMER
ccgcgttgaacggcttccca

SEQ ID NO: 588 - DNA, 20 bp, Artificial Sequence
  PRIMER
ctccgggttcgcagcagctt

SEQ ID NO: 589 - DNA, 20 bp, Artificial Sequence
  PRIMER
ccatgagcttgaacaggtaa

SEQ ID NO: 590 - DNA, 20 bp, Artificial Sequence
  PRIMER
gcgacggcgacccattagca

SEQ ID NO: 591 - DNA, 20 bp, Artificial Sequence
  PRIMER
tgcgctctcaccagcatcgc

SEQ ID NO: 592 - DNA, 20 bp, Artificial Sequence
  PRIMER
gtcctgggcgagttccgcac

SEQ ID NO: 593 - DNA, 70 bp, Artificial Sequence
  PRIMER
cagatttcagtctctcaccactcacctgagttgcctctctcgcgactagtggtctgaaggacgtggaatg

SEQ ID NO: 594 - DNA, 58 bp, Artificial Sequence
  PRIMER
cggtgggcaccctcccccgctggctcgacagggcatccccgttcattcgagggccggg

SEQ ID NO: 595 - DNA, 60 bp, Artificial Sequence
  PRIMER
ggggatgccctgtcgagccagcgggggagggtgcccaccgccgcccctcccgcccagccg

SEQ ID NO: 596 - DNA, 73 bp, Artificial Sequence
  PRIMER
gaaggtggtttttgcctgtataagccagccatccggcatactgcccgcggccgccctgcagtgcaggatctgc

SEQ ID NO: 597 - DNA, 78 bp, Artificial Sequence
  PRIMER
gaccaacttgtccgttgcgaggccaacttgcattgctgtcaagacgatgagcggccgcataacggtgagactagcggc

SEQ ID NO: 598 - DNA, 72 bp, Artificial Sequence
  PRIMER
atacaaacgttggcgaggcttctgcattcagctcagagtggcggccgcgtgctgcggaatcattatcatctg

SEQ ID NO: 599 - DNA, 70 bp, Artificial Sequence
  PRIMER
gcagcttgactaacagctaccccgcttgagcagacatcatcttaattaatcagtcagcgctctcgatggc

SEQ ID NO: 600 - DNA, 70 bp, Artificial Sequence
  PRIMER
ccaataccgccgcactggccgtagtgagactgggtaggtcatttaaatctaattccagctgggatcatag

SEQ ID NO: 601 - DNA, 62 bp, Artificial Sequence
  PRIMER
gcagcttgactaacagctaccccgcttgagcagacatcatcatgcgcttccgaatctacaag

SEQ ID NO: 602 - DNA, 59 bp, Artificial Sequence
  PRIMER
gggtgaggctggcggggtcgccatcgagagcgctgactgaggggtgatcccctcccctg

SEQ ID NO: 603 - DNA, 21 bp, Artificial Sequence
  PRIMER
caaccagactgtcccttctac

SEQ ID NO: 604 - DNA, 21 bp, Artificial Sequence
  PRIMER
cttcaagtcagccaactgcaa

SEQ ID NO: 605 - DNA, 20 bp, Artificial Sequence
  PRIMER
cagctgcggagcatgagcct

SEQ ID NO: 606 - DNA, 20 bp, Artificial Sequence
  PRIMER
cttttttcccaagatgatag

SEQ ID NO: 607 - DNA, 20 bp, Artificial Sequence
  PRIMER
ccaaccaccaccaccagggc

SEQ ID NO: 608 - DNA, 20 bp, Artificial Sequence
  PRIMER
ggttgagatattggatttgc

SEQ ID NO: 609 - DNA, 20 bp, Artificial Sequence
  PRIMER
cgaaaccgcaacggagctac

SEQ ID NO: 610 - DNA, 24 bp, Artificial Sequence
  PRIMER
taacttgtacgctctcagttcgag

SEQ ID NO: 611 - DNA, 20 bp, Artificial Sequence
  PRIMER
ttaggcgacctctttttcca

SEQ ID NO: 612 - DNA, 20 bp, Artificial Sequence
  PRIMER
gagaattacaccgagctgag

SEQ ID NO: 613 - DNA, 20 bp, Artificial Sequence
  PRIMER
tctacacgctgtggaacgag

SEQ ID NO: 614 - DNA, 20 bp, Artificial Sequence
  PRIMER
cgtcctccgtaatcttcagc

SEQ ID NO: 615 - DNA, 88 bp, Artificial Sequence
  PRIMER
agatttcagtctctcaccactcacctgagttgcctctctcgcgatcgctctagagtcgaccattctcacggtgaatgtaggccttttg

SEQ ID NO: 616 - DNA, 88 bp, Artificial Sequence
  PRIMER
caaaaggcctacattcaccgtgagaatggtcgactctagagcgatcgcgagagaggcaactcaggtgagtggtgagagactgaaatct

SEQ ID NO: 617 - DNA, 68 bp, Artificial Sequence
  PRIMER
aggaccttaattaatcatatatgcagatcctgcactgcaggcgatcgcgcggccgcctagcatcgact

SEQ ID NO: 618 - DNA, 60 bp, Artificial Sequence
  PRIMER
ggtttttgcctgtataagccagccatccggcatactgcccgcggccgcggctgatgaggc

SEQ ID NO: 619 - DNA, 68 bp, Artificial Sequence
  PRIMER
aagcgcccactccacatctccactcgacctgcaggcatgcgcgatcgcgcggccgcctagcatcgact

SEQ ID NO: 620 - DNA, 88 bp, Artificial Sequence
  PRIMER
agatttcagtctctcaccactcacctgagttgcctctctcgcgatcgcccttgtatctctacacacaggctcaaatcaataagaagaa

SEQ ID NO: 621 - DNA, 88 bp, Artificial Sequence
  PRIMER
ttcttcttattgatttgagcctgtgtgtagagatacaagggcgatcgcgagagaggcaactcaggtgagtggtgagagactgaaatct

SEQ ID NO: 622 - DNA, 20 bp, Artificial Sequence
  PRIMER
aactcggtggtgtcaaggac

SEQ ID NO: 623 - DNA, 20 bp, Artificial Sequence
  PRIMER
tgccatgactcactgattgg

SEQ ID NO: 624 - DNA, 20 bp, Artificial Sequence
  PRIMER
ttaggcgacctctttttcca

SEQ ID NO: 625 - DNA, 20 bp, Artificial Sequence
  PRIMER
gattgtcatggtgtacgtga

SEQ ID NO: 626 - DNA, 20 bp, Artificial Sequence
  PRIMER
gcgtcactcatcaaaactgc

SEQ ID NO: 627 - DNA, 19 bp, Artificial Sequence
  PRIMER
cttcggcttcgatgtttca

SEQ ID NO: 628 - DNA, 20 bp, Artificial Sequence
  PRIMER
aactcggtggtgtcaaggac

SEQ ID NO: 629 - DNA, 21 bp, Artificial Sequence
  PRIMER
cttcaagtcagccaactgcaa

SEQ ID NO: 630 - DNA, 20 bp, Artificial Sequence
  PRIMER
ttaggcgacctctttttcca

SEQ ID NO: 631 - DNA, 20 bp, Artificial Sequence
  PRIMER
gattgtcatggtgtacgtga

SEQ ID NO: 632 - DNA, 20 bp, Artificial Sequence
  PRIMER
gcgtcactcatcaaaactgc

SEQ ID NO: 633 - DNA, 19 bp, Artificial Sequence
  PRIMER
cttcggcttcgatgtttca

SEQ ID NO: 634 - DNA, 68 bp, Artificial Sequence
  PRIMER
gattaagttgggtaacgccagggttttcccagtcacgacggtttaaactcaaagtgggttcggtgatg

SEQ ID NO: 635 - DNA, 68 bp, Artificial Sequence
  PRIMER
gtcattaagtccatcattccacgtccttcagaccgaattcgcgatcgcgctgggctccttgtctgcct

SEQ ID NO: 636 - DNA, 20 bp, Artificial Sequence
  PRIMER
gaattcggtctgaaggacgt

SEQ ID NO: 637 - DNA, 22 bp, Artificial Sequence
  PRIMER
gttgagagaagttgttggattg

SEQ ID NO: 638 - DNA, 60 bp, Artificial Sequence; identical to SEQ ID NO: 519
  PRIMER

SEQ ID NO: 639 - DNA, 60 bp, Artificial Sequence
  PRIMER
cgtcaagctgtttgatgatttcagtaacgttaagtggatcttaagcaaggtggccgcccc

SEQ ID NO: 640 - DNA, 60 bp, Artificial Sequence; identical to SEQ ID NO: 519
  PRIMER

SEQ ID NO: 641 - DNA, 75 bp, Artificial Sequence; identical to SEQ ID NO: 520
  PRIMER

SEQ ID NO: 642 - DNA, 26 bp, Artificial Sequence
  PRIMER
gatccacttaacgttactgaaatcat

SEQ ID NO: 643 - DNA, 84 bp, Artificial Sequence
  PRIMER
gcgctggcaacgagagcagagcagcagtagtcgatgctaggcggccgcgcgatcgcggccggccgagtggagatgtggagtggg

SEQ ID NO: 644 - DNA, 68 bp, Artificial Sequence
  PRIMER
caaccagccgcagcctcagcctctctcagcctcatcagccgcggccgcccgaattgtctcaaggcaca

SEQ ID NO: 645 - DNA, 68 bp, Artificial Sequence
  PRIMER
tggaattgtgagcggataacaatttcacacaggaaacagcgtttaaaccaccacggactgcactcaat

SEQ ID NO: 646 - DNA, 24 bp, Artificial Sequence
  PRIMER
taacttgtacgctctcagttcgag

SEQ ID NO: 647 - DNA, 19 bp, Artificial Sequence
  PRIMER
catcctcaaggcctcagac

SEQ ID NO: 648 - DNA, 20 bp, Artificial Sequence
  PRIMER
ccacgccagcctttccgtct

SEQ ID NO: 649 - DNA, 20 bp, Artificial Sequence
  PRIMER
tggaggaagacgccgagcga

SEQ ID NO: 650 - DNA, 20 bp, Artificial Sequence
  PRIMER
gaccacgcggttgccctgaa

SEQ ID NO: 651 - DNA, 66 bp, Artificial Sequence
  PRIMER
tccgttgcgaggccaacttgcattgctgtcaagacgatgaggatcccactctgagctgaatgcaga

SEQ ID NO: 652 - DNA, 66 bp, Artificial Sequence
  PRIMER
gcgctggcaacgagagcagagcagcagtagtcgatgctaggcggccgctgcgacaactacggatgc

SEQ ID NO: 653 - DNA, 20 bp, Artificial Sequence
  PRIMER
ctagcatcgactactgctgc

SEQ ID NO: 654 - DNA, 50 bp, Artificial Sequence
  PRIMER
aaggggaccggccgctagtctcaccgttatcatgcaaagatacacatcaa

SEQ ID NO: 655 - DNA, 60 bp, Artificial Sequence
  PRIMER
caacgacctcgtcggcatcgctcccggccctcgaatgaacagcggcctgctcaaccagca

SEQ ID NO: 656 - DNA, 60 bp, Artificial Sequence
  PRIMER
ccaagaatctaccggtgcgtcaggctttcgccacggagctttaggtccagagggggtcgt

SEQ ID NO: 657 - DNA, 60 bp, Artificial Sequence
  PRIMER
caacgacctcgtcggcatcgctcccggccctcgaatgaacgccgccgagatcagcgccga

SEQ ID NO: 658 - DNA, 60 bp, Artificial Sequence
  PRIMER
ccaagaatctaccggtgcgtcaggctttcgccacggagctttaggaccagctcagctcgt

SEQ ID NO: 659 - DNA, 60 bp, Artificial Sequence
  PRIMER
caacgacctcgtcggcatcgctcccggccctcgaatgaacgacgaggaactcgtccagct

SEQ ID NO: 660 - DNA, 60 bp, Artificial Sequence
  PRIMER
ccaagaatctaccggtgcgtcaggctttcgccacggagctttagctgttgcggatgccga

SEQ ID NO: 661 - DNA, 60 bp, Artificial Sequence
  PRIMER
caacgacctcgtcggcatcgctcccggccctcgaatgaacaacaccgccatccacgcccc

SEQ ID NO: 662 - DNA, 60 bp, Artificial Sequence
  PRIMER
ccaagaatctaccggtgcgtcaggctttcgccacggagctttagacgacgagcatctcgc

SEQ ID NO: 663 - DNA, 60 bp, Artificial Sequence
  PRIMER
caacgacctcgtcggcatcgctcccggccctcgaatgaacatcagcgagggcgagaacgt

SEQ ID NO: 664 - DNA, 60 bp, Artificial Sequence
  PRIMER
ccaagaatctaccggtgcgtcaggctttcgccacggagctttagccccaggtggggtcgt

SEQ ID NO: 665 - DNA, 60 bp, Artificial Sequence
  PRIMER
caacgacctcgtcggcatcgctcccggccctcgaatgaacaccaagagcgtccccacctt

SEQ ID NO: 666 - DNA, 60 bp, Artificial Sequence
  PRIMER
ccaagaatctaccggtgcgtcaggctttcgccacggagctttagcgcttggggctgggga

SEQ ID NO: 667 - DNA, 50 bp, Artificial Sequence
  PRIMER
actaacagctaccccgcttgagcagacatcatggcgtcaacaaatgcgcg

SEQ ID NO: 668 - DNA, 20 bp, Artificial Sequence
  PRIMER
gttcattcgagggccgggag

SEQ ID NO: 669 - DNA, 20 bp, Artificial Sequence
  PRIMER
gctcgagacgtacgattcac

SEQ ID NO: 670 - DNA, 20 bp, Artificial Sequence
  PRIMER
gagcaggctcgacgtatttc

SEQ ID NO: 671 - DNA, 20 bp, Artificial Sequence
  PRIMER
ggcgaaataagctcactcag

SEQ ID NO: 672 - DNA, 20 bp, Artificial Sequence
  PRIMER
cgttgttgactggaaaaagg

SEQ ID NO: 673 - DNA, 20 bp, Artificial Sequence
  PRIMER
ccaatagcccggtgatagtc

SEQ ID NO: 674 - DNA, 20 bp, Artificial Sequence
  PRIMER
aacaagtccgtggctccatt

SEQ ID NO: 675 - DNA, 20 bp, Artificial Sequence
  PRIMER
ccaacttttcagccagcaac

SEQ ID NO: 676 - DNA, 20 bp, Artificial Sequence
  PRIMER
gctcactcaggaactgagaa

SEQ ID NO: 677 - DNA, 20 bp, Artificial Sequence
  PRIMER
ctcgactgagatgcgtactt

SEQ ID NO: 678 - DNA, 61 bp, Artificial Sequence
  PRIMER
actaacagctaccccgcttgagcagacatcttaattaaatgaccaagagcgtccccacctt

SEQ ID NO: 679 - DNA, 60 bp, Artificial Sequence
  PRIMER
accggtgcgtcaggctttcgccacggagctatttaaatttagcgcttggggctggggatg

SEQ ID NO: 680 - DNA, 20 bp, Artificial Sequence
  PRIMER
gccagcggcgcagaccggga

SEQ ID NO: 681 - DNA, 20 bp, Artificial Sequence
  PRIMER
gatgtctgctcaagcggggt

SEQ ID NO: 682 - DNA, 22 bp, Artificial Sequence
  PRIMER
cagtatattcatcttcccatcc

SEQ ID NO: 683 - DNA, 49 bp, Artificial Sequence
  PRIMER
taacagctaccccgcttgagcagacatcatgcgcttccgaatctacaag

SEQ ID NO: 684 - DNA, 49 bp, Artificial Sequence
  PRIMER
gacggtgggaaaggtggggacgctcttggtggggtgatcccctcccctg

SEQ ID NO: 685 - DNA, 48 bp, Artificial Sequence
  PRIMER
taacagctaccccgcttgagcagacatcatgatgccacggcatcactc

SEQ ID NO: 686 - DNA, 50 bp, Artificial Sequence
  PRIMER
gacggtgggaaaggtggggacgctcttggtttcgagcttcaggtcatcgt

SEQ ID NO: 687 - DNA, 48 bp, Artificial Sequence
  PRIMER
taacagctaccccgcttgagcagacatcatggcctcttcttcaaagac

SEQ ID NO: 688 - DNA, 50 bp, Artificial Sequence
  PRIMER
gacggtgggaaaggtggggacgctcttggtgaggtattccttgttgaatg

SEQ ID NO: 689 - DNA, 18 bp, Artificial Sequence
  PRIMER
aggccagggaagaagtcg

SEQ ID NO: 690 - protein, 102 aa, Trichoderma reesei
MASTNARYVRYLLIAFFTILVFYFVSNSKYEGVDLNKGTFTAPDSTKTTPKPPATGDAKDFPLALTPNDPGFNDLVGIAPGPRMNMASTNARYVRYLLIAFF

SEQ ID NO: 691 - protein, 391 aa, Phaedactylum Tricornutum; identical to SEQ ID NO: 140

SEQ ID NO: 692 - protein, 58 aa, Homo sapiens; identical to SEQ ID NO: 482

SEQ ID NO: 693 - protein, 407 aa, Phaedactylum tricornutum; identical to SEQ ID NO: 480

SEQ ID NO: 694 - protein, 392 aa, Phaedactylum tricornutum
MTKSVPTFPTVPTDSRPSAAFVVSDAPGAYESPLLVFTCRRDQYLRETLRDIWNYIPTDCSVGCPLVISQDGNDPAVRRVVREFTDEFATKNVPVIHWTHTSALRGSTNGYQALAIHYGWALRRVFDGQTLSGSVHGAKHGTPQRVIILEEDLHVAPDFFDYFAATAPLLDHDSSLLAVSAFHDNGFAHNVRNASRILRSDFFPGLGWMMNRRLWVDELQSKWPGGYWDDWLREPAQRQDRAILRPEISRTYHFGTEGGTSSNQFGSHLSKILLNRETVDWSKAADLEAQLRPEVYDPAYWAMVQASTLTYTIPDALEQAKKSNARLQYTTIEQFKYLAHKLKLMADEKANVPRTAYKGIVETRPHGADYFLFLTPPLAELQKEFDIPSPKR

SEQ ID NO: 695 - protein, 58 aa, Homo sapiens; identical to SEQ ID NO: 482

SEQ ID NO: 696 - protein, 391 aa, Phaedactylum Tricornutum; identical to SEQ ID NO: 140

SEQ ID NO: 697 - protein, 78 aa, Saccharomyces cerevisiae
MMPRHHSSGFSNGYPRADTFEISPHVPAKSHAPSPQETQEDSDSRRHSSCCHPRPRPLVRPAPICRLPHLARHLVWIR

SEQ ID NO: 698 - protein, 391 aa, Phaedactylum Tricornutum; identical to SEQ ID NO: 140

SEQ ID NO: 699 - protein, 86 aa, Saccharomyces cerevisiae
MASSSKTPGEAPVRYVTAMRAKAPSRRPLVITLSIMVLIMAIIGQGVMEIYGVSKPILNAQKFVPSWHGTLRDPTHPPAAFNKEYL

SEQ ID NO: 700 - protein, 391 aa, Phaedactylum Tricornutum; identical to SEQ ID NO: 140

SEQ ID NO: 701 - DNA, 64 bp, Artificial Sequence
  PRIMER
aagttcccttcctctggcagcaatcgaaccatcccattcaccttgtatctctacacacaggctc

SEQ ID NO: 702 - DNA, 61 bp, Artificial Sequence
  PRIMER
gtccatcattccacgtccttcagaccggccggccgaattctcatcgtcttgacagcaatgc

SEQ ID NO: 703 - DNA, 69 bp, Artificial Sequence
  PRIMER
cctcgtgtactgtgtaagcgcccactccacatctccactcgcgatcgcggtctgaaggacgtggaatga

SEQ ID NO: 704 - DNA, 62 bp, Artificial Sequence
  PRIMER
ctcaaacccctcatccactccaagtcaacatcaacagaactcacttcttgaggacgatgacc

SEQ ID NO: 705 - DNA, 88 bp, Artificial Sequence
  PRIMER
aacaaatataggcacacattggcactaatacgagcaccaagcgatcgcgagtggagatgtggagtgggcgcttacacagtacacgagg

SEQ ID NO: 706 - DNA, 88 bp, Artificial Sequence
  PRIMER
cctcctatgcttttacaagctgctcctctatccgcccccagcgatcgcaggtagacgctttgcgagtgtgtgtgtatctaagaagtgc

SEQ ID NO: 707 - DNA, 88 bp, Artificial Sequence
  PRIMER
gcacttcttagatacacacacactcgcaaagcgtctacctgcgatcgctgggggcggatagaggagcagcttgtaaaagcataggagg

SEQ ID NO: 708 - DNA, 92 bp, Artificial Sequence
  PRIMER
tcccttcctctggcagcaatcgaaccatcccattcaatttaaatgaattcggccggccggtctgaaggacgtggaatgatggacttaatgac

SEQ ID NO: 709 - DNA, 80 bp, Artificial Sequence
  PRIMER
ttcttcttattgatttgagcctgtgtgtagagatacaaggccggccgagtggagatgtggagtgggcgcttacacagtac

SEQ ID NO: 710 - DNA, 80 bp, Artificial Sequence
  PRIMER
atgatgcctttgcagaaatggcttgctcgctgactgatacccttgtatctctacacacaggctcaaatcaataagaagaa

SEQ ID NO: 711 - DNA, 80 bp, Artificial Sequence
  PRIMER
ttcttcttattgatttgagcctgtgtgtagagatacaagggtatcagtcagcgagcaagccatttctgcaaaggcatcat

SEQ ID NO: 712 - DNA, 88 bp, Artificial Sequence
  PRIMER
cctcgtgtactgtgtaagcgcccactccacatctccactcgcgatcgcaggtagacgctttgcgagtgtgtgtgtatctaagaagtgc

SEQ ID NO: 713 - DNA, 88 bp, Artificial Sequence
  PRIMER
gcacttcttagatacacacacactcgcaaagcgtctacctgcgatcgcgagtggagatgtggagtgggcgcttacacagtacacgagg

SEQ ID NO: 714 - DNA, 20 bp, Artificial Sequence
  PRIMER
ccgcgttgaacggcttccca

SEQ ID NO: 715 - DNA, 24 bp, Artificial Sequence
  PRIMER
taacttgtacgctctcagttcgag

SEQ ID NO: 716 - DNA, 20 bp, Artificial Sequence
  PRIMER
gcgacggcgacccattagca

SEQ ID NO: 717 - DNA, 19 bp, Artificial Sequence
  PRIMER
catcctcaaggcctcagac

SEQ ID NO: 718 - DNA, 20 bp, Artificial Sequence
  PRIMER
tgcgctctcaccagcatcgc

SEQ ID NO: 719 - DNA, 20 bp, Artificial Sequence
  PRIMER
gtcctgggcgagttccgcac

SEQ ID NO: 720 - DNA, 20 bp, Artificial Sequence
  PRIMER
tgcgtcgccgtctcgctcct

SEQ ID NO: 721 - DNA, 20 bp, Artificial Sequence
  PRIMER
tgacgtaccagttgggatga

SEQ ID NO: 722 - DNA, 20 bp, Artificial Sequence
  PRIMER
gatgttgcgcctgggttgac

SEQ ID NO: 723 - DNA, 20 bp, Artificial Sequence
  PRIMER
tgacgtaccagttgggatga

SEQ ID NO: 724 - DNA, 20 bp, Artificial Sequence
  PRIMER
tgcgtcgccgtctcgctcct

SEQ ID NO: 725 - DNA, 20 bp, Artificial Sequence
  PRIMER
gattgtcatggtgtacgtga

SEQ ID NO: 726 - DNA, 20 bp, Artificial Sequence
  PRIMER
caagatggagggcggcacag

SEQ ID NO: 727 - DNA, 22 bp, Artificial Sequence
  PRIMER
gccagtagcgtgatagagaagc

SEQ ID NO: 728 - DNA, 20 bp, Artificial Sequence
  PRIMER
tcatcaagctgaaccagcag

SEQ ID NO: 729 - DNA, 20 bp, Artificial Sequence
  PRIMER
gagcaggctcgacgtatttc

SEQ ID NO: 730 - DNA, 20 bp, Artificial Sequence
  PRIMER
gattgtcatggtgtacgtga

SEQ ID NO: 731 - DNA, 19 bp, Artificial Sequence
  PRIMER
catcctcaaggcctcagac

SEQ ID NO: 732 - DNA, 20 bp, Artificial Sequence
  PRIMER
atgatgactccaggccaaag

SEQ ID NO: 733 - DNA, 20 bp, Artificial Sequence
  PRIMER
gatgttgcgcctgggttgac

SEQ ID NO: 734 - DNA, 20 bp, Artificial Sequence
  PRIMER
ctccgggttcgcagcagctt

SEQ ID NO: 735 - DNA, 20 bp, Artificial Sequence
  PRIMER
ccatgagcttgaacaggtaa

SEQ ID NO: 736 - DNA, 20 bp, Artificial Sequence
  PRIMER
gattgtcatggtgtacgtga

SEQ ID NO: 737 - DNA, 20 bp, Artificial Sequence
  PRIMER
caagatggagggcggcacag

SEQ ID NO: 738 - DNA, 22 bp, Artificial Sequence
  PRIMER
gccagtagcgtgatagagaagc

SEQ ID NO: 739 - protein, 670 aa, Chlamydomonas reinharditii
MGSLALLTYVWVVFVLHPARVADAAVTQGGADSGGARIGRLRLNTGGATGHDLSHLLFQTPSHPTKPQKTAAAKASSPPPPPPDEDDVPEGPHPMRHYPYQDAKYRIWSLPKEDVSPRCRASGICDGKYDCGADGMGCITDALKRKMKVRDAAAWTWKGYRQYAWGHDELNAGSRNSREWFNMGLTIVDSLDTLQILGLLEEYAEARYWVVNHLDLNQGDVSVFETTIRILGGLAAAFYHSGGDEAFLMKAVEFADRLMPAFNTSSGLPQPHFSVHDKNVATYRGSAGSSCLAEIGTLSMEFTAVSRLSGRPEFRDTAMKTWPIIKSMPSMDGLYCTMLNADLLSCNGNHYTFGASADSTYEYMLKQWVLTNGTDEMCLDMYKKAIGGMRRHMLTELWMGPDIGEVWIAAENDAGASRNLVLEHLTCFLPGTMALGHMYGVNTGGAGEDDDLMVAIKLMKACYELYHQTPSGVAWDSVHLDEPVEVTSTREAGVIDSDDGDDGADGVDGLGYVVLDAEERRHLMAEASGGAGDGAKPPGWGKVKYEFAPRSRENFLRPEVAESLFYLWRATGDPIYREWGWNMFRAYERWCRVDSGGYQMESFWIAETLKYFYLLFSDDPNEIPLDEFVFNTEAHPLAIWGSATDRKLRKILERAFYAFLMHQHFRNDAL

SEQ ID NO: 740 - protein, 852 aa, Volvox carteri
MLTSQKYIQSGICDGNYTCGVDGLGCITDALLRKEKVREAARWTWKGYRQYAWGHDELNAGSRTSREWFALGLTIVDSLDTLQILGLLEEYAEARFWVANHLNFNQGEVSVFETTIRILGGLVAAFYHSGGDELFLLKAVEFAESVHDTEEPRGKFGIGSTCLAEVATVSMEFSAVSRLSGRPEFRDTAMIPWQKLTSMQDLDGLYCTFLNGDSLGCSGNHYTMGASADSAYEYMLKQWIMNKNDSMCIDMYKKAIGGMRKHMLTQLWMGEDIGDVWIVAENDGGRTRSNILEHLTCFLPGTIALGHMYGINTASSPDEDDDLTVAVKLMKACYELYHQTATGVAFDSVLLVPRYSPEPVVDKGIGQFQTGTTFTAGSTATGNGNQQESSGKGRILLQDGGSAGKTKYAFAPRSRENFLRPEVAESLFYLWRATGDPIYREWGWNMFRAYERWCRVSTGGYQVLNNVDTVPPSVGNKMESFWMAETMKYFYLLFSDDPDEIPLDEFVFNTEAHPLAIWGTETDLTLREVLANAHGRLEASGVNALGKSAQYYQSNLMGMTAAERHKKFVNDYLTYYACGRDEPSTKNDAARIRTDADALREHHRFIRSDADNESSSWEARLAKRYYDRLFKEYAIVDLTYYKQSKLGMRWRTQKEVVSGKGQFVCGAKGCDAGEGLCSYEVNFAYQEAGERKQALVKLRLCPACAFKLNYRKEKQLQKAADAAAARKRKREQELEERMPNDPLVQEALEYVQRYAHGGSDEAGPFNPEAGIGTADFERATGDVAPPPAATAARAGGSGVAIDALGGTGTEGAQRAPAVITLPADNSVWELKPAQETVNVEEEMDAYFEGLFL

SEQ ID NO: 741 - protein, 475 aa, Ostreococcus lucimarinus
DAGRRDEVKAAMREAFGAYRTHALGHDELAPRARTGRDDFGGIGATLIDSLDTLHIMGLRAEFDEALRYLKKPGSAFRDLVQGETDRDVSVFETNIRVLGGLLAAHDLSGDADVLELAESIAARLSAAFDTPSGVPHSFVNVKTGNSFGLPWTKGASILADFGSMHLEWATLSARTKNPVYEAHTNHVFETVSSLGRRGKSGASTKGLFSAHFNVDTGEFAGGDVTFGALGDSFYEYLIKCWRSLGDLKDAETWREMFDEAMLGMKTSLLRDWKTDEATGEKYSYVSPIGGSGAGSMEHLACFVPGMLVLGAAEAPTPTTADEYVQIAKDIARTCVEMYSSQPCGLSADHVRFDSGSKTISNINGKNIQRPETVESLFYLYRKTGDEIYRTQAWKIFQSMKSAYRVPESGGWQGVLDVSKTPTAGDDKMQSFFLAETLKYLYLIFTDSDTMHLDEWVFNTEAHPLRITKARERLN

SEQ ID NO: 742 - protein, 497 aa, Ostreococcus tauri
MWSRTRRRGWSGEEGRGRRYWATTRADARRRDAVRDAFRECLTAYVTYASGHDELAPASRRGVDDFGGVDTTLADALDTMFIMGMKKEFAEGLGRLKAETSGFRALINGEVDRDVSVFETNIRVLGGLLAAHDLSGDGDALELAESFAARLSAAFDTPSGVPKSFVNVKTGKSFTLQWTGGKSILADFGSMHLEWATLSARTKNPVYEAHTGHVFEQIARARRNSGAPVGLFPHLYDTDAGKFAGGTVTFGALGDSFYEYLIKCWRSLADLKDAPLWREMFDDAVAAMTAANMTREWKREGDDVYLALSPIGSTYTMEHLACFAPGMLVLGGAEAPTKALAEEYVELARKIARTCVAMYDSQPSGLAPDHVKLVPSPSSPSMNVIDGKNIQRPETVESLFYLYRKTGEEQFRDQAWKIFQSMKAAYSVPGSGWQGVRDVRQSPAQGDDKMQSFFLAETLKYLYLIFSDSDEMHLDEWVFNTEAHPFRITKTRAKSDG

SEQ ID NO: 743 - protein, 517 aa, Micromonas pusilla
MKIDWAPLAELTAPQNIERMSSGGDFPRPETSTLARNSGPNGEVAHSGRVPNAKWATVYVDEEKRDAVRDAMRDAYNAYETYAMGYDELQPLTKRGKNAFGGLGATVIDSLDTLWIMGLKDQYSRARNWVADRLHFDRNYEASVFETTIRVVGGLIAAHDLSGDEMYLAKCLDLVRHLKPAFSTETGIPYNIVNLKKGWAKNPTWSRGASTLAEFGTLQMEYIALSERTGDDEWRQLAESIVETVRKIRTQTGTPLGLYPLYLNPHRGTWENTHVSFGAMGDSWYEYLLKVWVQGGRTKAMKGWHDMWEESMRAMIDKLVFDGEEEGTKYVAEYNANHAVHKMDHLTCFVGGMLVLGSHGSDHEDEYMKVAAAITKMCWRMYSTQPTGIAPEFVNFQDKKMHVGGKFNIQRPEAIEAIFYMYRKTGDPVYREWAWEMFTNMRRHYRTETGWVGLKDVRSPNPGHDNTMQSFFLAETLKYFYLIFSDSDTINLDEWVLNTEAHPIRVMPRDKSDVGTN

SEQ ID NO: 744 - protein, 631 aa, Micromonas pusilla
MTHRAAALAFALATLLASGVVVAAPEPDALGELRVANASSSSSSSSSSARRRLTFASRSRGGEPSSGASASEPPRDLEWLLRATSASPRRREDWRDGLGFATAIDALSPSDVDALLSLSDDDFRAIPTETRRAAVKASVQHAWRGYRDHAWPHDELAPLSRSGLRWLDVGVTIVDALDTLLIVGLDDDAAEAISWIAGGGGGDGDGTGATAAAAETRGGGLTFDSDVNANVFEATIRVLGGLTSAHKLGGDTRDGGVLRKALDLAEKLLPAFKTASGIPIMDVNFATGDAHQPTWTNRASLAEVGTLVLEWAALEEALLVAENRSETTRTRQRWVMHGLITKGLWDPATGGLLPSSVSAVTATFDASSTLTLGARGDSYYEYLLKHWIHAGKPAGGERAYLNAMDGVLMYLLHRAGGEALNHKMDHLACFLPGVLALGASLPASTTHLDIARELARTCVQMYARTSTGLAPEMVHFAAEGASTTSHGDFVVKLQDAHNVLRPETVESLYVLWKTTNEREWRDAAWAMWRAWEIHAKVPSGGYASLRDVENGDNSEEGAKIDRMESFFLGETLKYLYLTFSDDPALLPMECFVFNTEAHPLPVLRDGVSDGRACVERVVEGHVETLAETLGV

SEQ ID NO: 745 - protein, 555 aa, Micromonas pusilla
MTKQDARAEATAREEEAKIFSAPAPTDAAVSAARRDSERLAPAKEWSFPLPRRNDRGVVVTGDGGAAAKRGDVPYGGWARDIVADVARRDAVRDATRDAYAHYEKYAFGDDELRPRAKLGKNAFGGLGATIVDSLDTLWIMGLSDEYGRAREWVSRRLSFDVDRDASVFETTIRVLGGVLAAYDLSGDEMYINKATNLATRLKPAFATASGIPYPIVNLKTGRAKHPGWAHGSSPLAEFGTLSLEFVSLSDRVGDPRWSDLAETPIAKVQSVRGDVGTVPRGLYPMSIDPGKLKWSSGAVSFGAMGDSFFEYLLKTYVMGGRTRELRGWSDMWDESMRAMLEHLVFPGEEEGTKYVAEWNGRAHHKMDHLACFVGGMLVLGAHGSDMEKEYVAAAAEITKMCYRMYTSQPTMLAPEVVSFAKYEKENGGTPRGRRMVNQVNHNLQRPETIESIFYMYRKTGDPMYREWAWNMFCAMRKHYKTDSGWAGIKDVRRDPPTNDDTMQSFFIAETMKYMYLIFADGDVIDLDEWVFNTEAHPLKVKPRRETLVPPYKYS

SEQ ID NO: 746 - protein, 464 aa, Coccomyxa subellipsoidea
MRHSWAGYAQHAWGFDELMPLTQNGKNSFGGLGATIVDSLDTLWLMGLKDEFKAARDWVVNELSFNKFYEASVFETTIRVVGGILTAHELSGDEAFLRRAEELVQILMHAFDTPTGIPYGTINLQTQQGRNPTWTQKASILSEFGTEQLELIQTSLKTGNPVYAQKTEAVIKFLNDKWCSMQGLLPLYIHPQTGQATTQMVSLGAMGDSYYEYLLKVWIYKGRRAEDEMYRAMWERSMDEMLRKLLFKNEESGYTYVAEFARCGSPLLHKMDHLSCFIPAMLALGAHASAVTGAKATRYLQVAEELTHTCWQMYHQMASGLAPEYVEFGTAGMVTAEKAKHNLLRPEAMEAMFVLWRVTQKEQYREWAWEMFLAFEKNCKMPVGYAGLKDVTVVPPPTDNTMQSFWLAETLKYLWLLFAPNDVVSLDDWVLNTEAHPLRIIKKLPDFLTSNNTAQAQVNPVVMN

SEQ ID NO: 747 - protein, 699 aa, Chlorella variabilis
MLPVTTGISPPRRARVGSTSNLTRRLGRQAGTPAAIVLAALILIGGISFLLHNRISDEEEGHGLHVVSSKRRSLADDSGGSGSGVAERIQLLAEGAELENDRMAQLEDEQQQEDSDSELSGTLFGAKEGVKLANGQQVAAMAAKTGARNAANSRTRSTQFQKASPSRFAKKLEETRHRVGLQAASRQRYSAIVSSFPSQPEPAVEELSEAEVARRREAIKAAMLHSWRGYEKYAWGQDELCPVSQQGKNSFGGLGATMIDALDTLHMMGFHEEYGRAAEWVRSEMPLNASFDASVFETIIRVVGGMLAAHDMTGDKVMLERAQQVADRILPAYNTTTKIPLNIINLATQQAKNPTWNQRASTLAEFGTHQVEFWRLSQSTGNDTYAELAEGTIRHLHKGWPQQGVMPLFISPTTGNFTARRVSFGALGDSYYEYLLKMWLIKGRQDEMYRSMWERAMDEMINKLVFTSREGLTYVAEFDRSIIKHKFDHLVCFVPGMLALGAHSGAVQGAKAERYMQLAADLTHTCWQMYHRMPSGLSPEYVTFSAQGMKVGAAYNLLRPEALEAMWYMWRLTHDWKYRAWGWQVFQAFEAHCKVEAGYSGIKDVRAATPVPDDTQQSFFLAETLKYLFLLFSDDSAFDMDEWVLNTEAHPLRTTQPKQEEQQHERQQQERKRWWWPPSRSKSGGGLISGSDGSGSIAR

SEQ ID NO: 748 - protein, 661 aa, Cyanidioschyzon merolae
MQWRPVEQHVPKASYHELDFCGSKTMNTFCGLNPGLTRRTVHRTINSWQRTFSRFRYYRQLLALTVFTLLLWMYRVGRPQALDDENELAGRLQPRLPGLLAKALSAGSTQRRHQSYSRWPPALRPNLTLGNELFLDDVTRNERRREAVRRAMQHAWRGYRQYAWDHDELRPLSHSYEDSMNGVGLTLIDALDTLYLMGLHDEFRDARAWLARSEHRFARPKAEPVSIFEMNIRLLGGLLSTYQLSGDPLFLQKAEELGHLFAHAFLGRPPPRMPHPSCRFRVRSQRTGSDDENGTIVTCRAAERVVLSECGTLQLEFRALGAATRDPLLKGLAERADQVLRDIIARAPLDGLPNNILSSADGSSFVNKSAEIVRFVNLGAAGDSYYEYILKSYIQLGRTDPFWRRESDRIIDALERIVFRRGVLIETLESPSDPARQTERQHQLKQPLKRFVNVSWPVVLSNSEEIHQPDHLSCFASSLFVLAVPPEQWDASVRNDRAERLLRLAGEHARFCFEMYLVNAGLSSESVEVQPSSPQDSPYADRPLVQIRSYVRGYHQRPETLEALFYLWRATHDPKYRDWGWTIFQAMEWYTRVPSGGYVGCRDPDNGCRIPIDKMESFLLAETLKYAYLLFSDDAALDIKNEWVFNTEAHPLRIMSVSRER

SEQ ID NO: 749 - protein, 489 aa, Phaeodactylum tricornutum
YVDGTPGPYEITETLRQQSDQVARSRRFHVQKAMRFVWGNYVKYAFGKDELKPQSASGSDQWGGQGITLVDSLDTLWLMNLKDEFWQARDWVRDHLDHSTVGSVSVFETTIRDLGGLLAAFDWSKDRVFLDKAVDLGDRLLRAFDGATTGIPWGEVNLASGNRKNIGWSGDNAIVAEFGTVQIENRYLSKLTADDKYAKKTERVYEILDEISYPDGLYPYYLRNDPRNKGKFLRDGVTIRPEFSNDKLTFGAMADSLYEYFLKTWLQGGRTEPLYRAMYDKSIQGMHDQLLQTSTPSKLTYIADKNRNSGTMDHKMDHLVCFMGGLLALGAYTDPLGLDSTRAQRDLQTAKALTYTCYQMYARMNTGISAEYVQFYAGRDFQIGRGAPHYLLRPEAVESFFILHQLTGDPVYREWGWEVFQAIEKYCKTPYGYGALNNVADVNGKPRDSMESFFLAETLKYLYLLQDPDTEVDVLHKHVFNTEAHPLRI

SEQ ID NO: 750 - protein, 446 aa, Thalassiosira pseudonana
MKHVWKNYRELAFGKDELHPVSGKATNSWGGMGATLVDSLDTLWLMDLKKEFNDGKDWVEKTMSHTMVGEVNGFETTIRILGGLLSAYDLSNEVVFLKKAEYLGSRLFKAFDSKSGLPKGKINLSNGRSRYSGEGHSFVLAQVASLQLEYRDLAQATGKSEYATKSERVFDILGRIMPRDGLLPLNIKEKRNGDVYFSNSKISFGGMGDSAYEYFLKAWLQGGRKEKSYRDLWDRSVNGMHRNLLQKSSPNGLTYIAEKNGKKMDHKMGHLTCFMAGSLALGSYTDPDGFDSPRAQRDLKAAKALAYTCYQMYARSKTGISPEYVNFNGCDDFHISVSAPNYVLRPEVVESFYYLSVLTGDPIYREWGWEVFQSIEKYCRAQYGYGSLKNVDLPSMQPQDEMESFFLAETLKYLYLLFDPDSEIDILNKHVFNTEAHPLKIFEDSV

SEQ ID NO: 751 - protein, 449 aa, Thalassiosira pseudonana
VKEAMRHAWNGYRKYAWGKDEVLPLTHGGQNNWGGQGTTLVDSLSTLWMMGMKDEFNEARDWIRDNLDFSKVEGAVSVFETTIRNLGSLLSAFDMSGDKVFLEKADDLGNRLMRAFDTPRGVPFGEVELFDGGSAYNTGWHKTSAVLSEIGTLQVEFRYLARVTGKSEYATVAMRALDELLKLDTESGLYPTFIHNTKNSLSFANNDISIGAMGDSFYEYLLKIWLQGGKTEGNYRILYDRAVDGILDYLVHSSRPNYLTYVAELSQGKVKHKMDHLSCFLGGNLALGAYTHPDGLASMRAQRQLKVGKQLAYTCYQMYARSKSGLSPEYVSFEGSDDFVKAHDAPYYNLRPETSETFFILYHLTKDPVYREWGWEVFQAIDWHCRTDAGYAAIKDVDTMQKNNRMESFFIAETLKYLYLLQGDSHGLDLLNKHVFNTEAHPLRLLDLL

SEQ ID NO: 752 - protein, 445 aa, Thalassiosira pseudonana
MKHVWKNYKEYAFGKDELHPISHKSTNNWGGMGTSLVDSLDTLWLMDLKDEFYEARDWVRESLSHSHVGDVSAFETTIRSLGGLLSAYDLSRDAVFLEKAEDLGSRLFKSFNTPSGLPHGSVNLQTGTSHNFGWNGNAYILAEIGTVQIEYRYLAHATGKTEYATKSERVFDILADIMPKDGLLSQNLKDKGGSAYFSNDKVSFGAMGDSTYEYMIKMWLQGGRKEQKYRDMWDHSMSGVHEQLLQKSSPNGLSYIADRVSGRIDHKMDHLVCFMGGALAIGAYTDPLGFDSPRAQRDLKTAKALTYTCYQMYARSKTGIAPEFVRFAGGNDFEIPSSAPFYILRPETVEAFYYLSVLTGDPIYREWGWEIFQSIEKYCRVQYGYGSLKHVDNVNMNPEDRMESFFMAETLKYFYLLFDPDSEIDILNKHVFNTEAHPMKIFESQ

SEQ ID NO: 753 - protein, 455 aa, Fragilariopsis cylindrus
MQHAYHGYEKYAFGMDELTPISKSGHNNWGGIGTTLVDSLDTLWLMDMKDEFYRARDWCKTSLNHDIHKKVSVFETTIRSLGGLLSAYDWSGDQAFLDQANDLGERLFKAFDTESGIPRGQVNLASGHSDNIAWTGSSAILSEFGTIQLEYRVLARLNGRKDYKDKVEKIFEIMDEMNPEDGLYPYFIRNTGDKPEFANKKITFGAMSDSFYEYMLKIWIQGGKTEPLYRKMYDKSIQGMHDELLSVSTPSGLVYIADKNSGTMDYKMDHLVCFMGGLLALGAYTDPQGLQSDRAQRDLKTAKALTYTCYQMYARMPTGISPEYIQFRKDNDFESGRGAPHYLLRPETVESFFVLYHLTGDPVYREWGWEVFQAIERYCKTDAGYGQLKDVRRVGRPAEDKMESFFLAETLKYIYLLFDPETPIDLLNKHVFNTEAHPVRTFPAMDKDGVIDLLK

SEQ ID NO: 754 - protein, 625 aa, Fragilariopsis cylindrus
MKGFCFVSILSLVFVYFTLQILPSEEWFTSEHYKDKKCRHLKPINPNIDLSVLGAERRERFKAVQRAIGHSWQGYTNIVSLDSYWNQGFIPHDDLKPQSIQGHSWLHYGATLHDSIDTLYLANYTKEYEQAVRWSTSYDIQTTSPQATKTFEYSLRILGGLLGAYSISGDPRLFSAAQNAADAILEGPFQASPTIVPRPFNVLAPSVSSFNECTWIWDWKWKATIQRLYQAAYTAGRNQFTKEHRSNSLAGFGSFGLEFSFISALTGDPKYKKKSDDIFYHVQTYEKNGIIPSSWDVLTGLPISHSGSLGSGSDSFYEYLIKIPVLNSCYYDDGMEMYTDSCTDSDKDHSKLYEKMVRETLTPFHVKRQSIGDDINSTKSQQSFPVDYSNHYDHLLCFLPGMLSLGASSKYPSGSKSLVDNEQHRLARQLLEGCAAIYRRSQTNLSPDTGSFRPGKFNVDDPSFYLRPEYVESLFVIYRLTKDRELQDMAWDVFQSLEKYCKISSGGYAVLKDVNDHKKGHHDDMPSYFLAETLKYLLLIFAPDDYVSLDDFVFTTEAYPLRKLQVNEDVLPLCFLQCRPPTPMPWTLLCFGGIIISVYVAMFFVVSNVSRTFLIALVNDKRKTL

SEQ ID NO: 755 - protein, 461 aa, Aureococcus anophagereffens
RRAAIAAAVKHAWQGYRDRAFGRDSVAPVSGRAVGSGFDMAVTLVDSLDTLWIVGLKEEFKEARDFVATEAFGKKLRSPPSSASIFETTIRVLGGLLGAYEVSRDKIFVTRALDIGNVIHGKLDKRSGVCPPSFGARSGGGCPSLAHAGTTQLELIYLARVSGDPKFLKTARLFYDHIKRAARLEPGLYAQCVGASSGKITLGAEADSFYEYLPKVWLLQGGADRRATRTKSAEPLDFEDAWQMYNDALDGMEQRLTSRGDDGLLYLDNLNWRGGSAFSRESAMEHLQCFVPGWVALGAAYQDDPARAARHLALADELATTCFAMYDKQPTKIGPERVKRKRMDLSATDTKEYILRPEAAEGWWYLSILPGLDHMRDKYRAWSWQSFQAIDDLLRAPFGHASMRDVSKPRASASANRLDRMESFWIAETLKYFYLIQEETPSFPLDAYVFNTEAHPFSIHT

SEQ ID NO: 756 - protein, 1193 aa, Aureococcus anophagereffens
MGHDAGAAPDAPLRRSLRGGAGAAPPPIAAAPVAAAPIAAAPNAAAPKAAAPIAAAPAPPAAAPLEAPRAAPPPPAASTDRSRRVKSLRSLRDGTAYARASAPLDRDSVSGAAFVYVDGADKSADIKTVVSNKETGCDVGDARDGYALAVNNWETRDGQLTLEWGDAATGCRKLASGPRAVVAPDRWTHVAFVLSPTTAALFVDGAEVARERVGDRRSPQRTQPLRVAQYADAFYPFVGNISGLVIFDGALTASDVRALAAASAPGAAAAPPRTGPAVAASFPLADWPGAKGANVAGDGRGLAYARASPAARAGAARASPGGSFAVGYDAWEPTPEKLAASDATAAGRAAKVRDAMRHAWKGYKDRAWGRDELKPVSGRGHDNWGGMGVTLVDSLDTLWLMGLRQEFDEAKKWVRDSLRFDRTGDVSVFETTIRELGGLLAAFDLSGDKVFLDKARDLGQRLAHAFDTPTGIPKGSTSLREGRAKDVGWTGGNAVLAELGSVELEFRYLGYKLGDASFSDKANRVFEQFSTMKGTQGLFPIYVDPRNGGLKSRKITFGALGDSYYEYLLKTWLQGGRTETRLREMYDEAMDGMVDLLLQHSSPSNLAYVADIDGGTVHKMDHLVCFLGGVLALGAKTDPRGFDSPRARRDLHVAEALTHTCVQMYLRQPTKLAPEFVTFRRGADMVVAPSAPFYILRPETAESLFVLHEVTKNPVYRDWGWEIFSAIEARCRTAHGYGSVPDVRKVTKPDDRMESFFLAETLKYLYLLQDPNHAVDLETAVFNTEAHPLRNIGPGKFTDNMVPKFLLFFCGAAAALVAPHPKRACVAARPSVALPDADVAAVPGDGEADRPPELEASGPAPATLATPFRAGFVGVVGSPNVGKSTLTNALLGQDLCITNSKAQTTRHRILGVANGDGYQLVLSDTPGILCDPAYALQSTMMTAAKAAARDAECVLFVTDVFEDPEVVAESAAWLDAQLASRAGDEPKPPVVVALNKVDLLGVDDDGYPLLGEAASRRVGSLDDAVARARAAVPGAAAVVPLSAATGAGVDELARALASELPESAALFDDEYFTDRPSRFFAAEIIREKILAQFAKEIPYSCEVRIDRFKEDLELKGRPFVNIDAAVLVARDSQKGILVGKRGAAIKAIGVAAREHLETFFDAKVHLALRVKVSKDWRADEGKLKAMGYPVAGR

SEQ ID NO: 757 - protein, 764 aa, Emiliania huxley
MRQHSDFSDAFGPLSSKRRRGTNFAAVRRRLPWLFIALLLVYGLSFLWGGAEHASGGSDPAMEALGIKMVQQARGKVSEPGCDRGAAGAQAASGSAMAGDFKSLRPKSDKVELRAAGAALDGASLSLAAWVLPPAPADGKVLSIQTIASTKASGCAVDADHRGVAVFLNEWQTNSGQLYLSWGSAASGCEEIATAVNSVKPGRWTHVAATLSASRARLYVDGELLADSERDGSGKLLGVDNFHHGGDQSAGVSDRLFRGGETALRGSLSGVDELETVPIAQVVPKEDVAISARYAEVNASDALARVRLEAVRGAFKRAWGAYRKHAWGMDEIKPISNKSHDWLHLGATMIDCLDNLWIFGLKAEFDEAKEWVATKLSFSRAVGISMFETVIRIIGGLLSAFELSREAVFLRKAEELAGLMMYSFKANPETGVPCTTISLDGSRRCTFPTWTQRNAILAEFGTIQLEFKYLAHHTGRKEFWEVAERQIRNVRGRTQPAGLYPNFMSPKTLRWTTTKVSMGALADSFYEYLLKQWLLTQRTEPYLRTMFDEAMLGMARSMVARSTPSELVYIADYVSEGKLVHKMDHLACFAGGMLAVGAQHGGEFDREYMTLAERIGETCYEFYRRTTSGLSPEFMSFVGGSDPKVPRNAAYNIGRPEAVETFFIMWYYTRDPKWREMGWEVFSSFERHARTPSGWAALKDVNNPAKLDDKMESFVLAETMKYLFLLFDSSYPIPLDKYVFNTEAHPLGTFDASAFTSAAPPKRR

SEQ ID NO: 758 - protein, 549 aa, Emiliania huxley
MACLVLTAALAIPGATTDGECAAEDAPPAVVRRGAQVERQNATRSAFLHAWRSYATYAWGQDEVNPVSRLAVSSFGMGLTLVDSLDTMHLMGLSEEFAAAVAWVRTRLRFGEQEEINVTIRVLGGLLSAYELSGERSVLDAADELGQRLVFAFDSPTGLPYGTVGLKSRKRYNPTWSRGAPRASTVAEVATLQVEFRALSRHARRPPVYEAVAQRVMAHLREMSRLYPTMISPVSGEFASSDLTLGARADSAYENPAQAYLLKQWLMSSRTDSRVAQMYTESVAAITAHLVREGGLARCANCTYIGRWNFRTKRYEDKMDHLVCFVPGMLALGAHSGIHGVRGGAAARATMALAEQLMETCYRMYSDQPTGLAPEIAELREGTSRVAADSGARHNLLRPETVESLFVLWWVTGDEKYRDWGWHIFVAFERLCRLQDGGYSGLKDVTDRHGGGHNGKMESFFLAETLKYLWLLFGDGTEVPLDEYVFNTEAHPLRIHEDYRFGSRFGSLPLAEDLANDSPERPLFDQSVRARVADRAELLARTFPAAAET

SEQ ID NO: 759 - protein, 590 aa, Emiliania huxley
MITFFSMETRRQEEQREMQKELHRLRTDNLAKERKLIKLAERAESWRFDRGGESEDDAGGEFNEDEWSEESDEHPPGEDGTPYGAEALAPEEEALPAEKRAGCARLKEGWWVYEVCLGQHVRQFHAADAKAAFAENMLGMAPHACGAEEAGCHCMRLREDDAALSCHKAEEEYVRGDACPDRESTRSVTVKLVCREGEEAADSVLAEGALALVSVHEPETCRYEATVEAPAGFGGEEAGCGGGAARLGEGGKDWVGLGLTILDSLDVLWMANLTKEFAHGVEWTIPNWTGGSLLLAEVGTVQMEFFALAHHAGRPEFRERAQRAIDLLDSQGGGLTDGGRLWPIHIRPESGRPSGSTISWGAMGDSFYEYLLKTWLLTGKKHEQYKRMYLEAVKGMQRRLIIEEGGLTYLCEEKSGKLVRKMDHLVCFVPGTLALGAQHLPEQHDEHMALAAKLAETCHRMYTLTPTGLAPEFVKIVGGSMVAGANHNLLRPETIEAFFYLWRFTKDARYREWGWEIFSAFERHCRVPSGGYSGLKNVKLRGSAKDDTMQTFWLAESLKYFLLLFSDDSLLDLNTHVINTEAHPIKILPS

SEQ ID NO: 760 - protein, 414 aa, Emiliania huxley
MLAAAAAVAGALPPMPDSLAEAANAVREEGRSTWAAYYKHARGFDSLRPLSHRGVNDWGSVGMMAIDCLDTLWLMNLTAEFKQARSIVEEIDYTPAGREARSVSTFEMTIRGLGGLLSAHALSGDRLFLRKAEQLGEALNTAFVPGRFPLPSSSGGAHPTGRVSLGAMGDSYYEYLAKTAILDPRLRPTAGAMFKAALLEIEQQLLVPREHGRTFLAEESAYTSLDDVYAQPSRRRDDMPTFWLAETLKYLFLNFAPPTLLPLDGWVFNTEAHPLRIFPRGAEAAGAAAAAAAAAAEQAKVASLVAQLQGQEQAALEQMRARAAQRQARLAPKSARRYVGRSQSPFSSRWAKRAGSRAPERRASLREERKGRMLEIEEKLRRVHGATRDSSEHVLKAPSRAGARLRQSPSQTST

SEQ ID NO: 761 - protein, 735 aa, Guillardia theta
MIALHRSNRDVMYAKSLGKKYSSLPESPSSVILDISLIFVLFFLFLALVYHLIYDIFGTNLHSLLTGGISRTFFVSVCLGIILRTLKNLYLLIRTVESSSDASVIQWYRHLLTLTLFGAYFLAFFNGKDISKHVMQLWSSFDVASFHSHFNNNNNNNAIKITYNQHDWEREREALMQVAEPAAALLSDTVAPKVAEDCAIREKALMQQASERKRMPHRLMQESTRGHETAQWSSVGSTPGREQGGPSSAAKELAAKIANEQALASMVNEPLDIFDDDDSTRIKRLAIKNAFLHAWEAYEMHAFGKDEVHPLSQQGHDIMGLGVTIIDALDTMLVMGLASSPVYKRARSWVQSGFDPKPNKDISVFEATIRVLGGLLSAFGLTGDRMYAEKATELGDVLLTAMQTPTGLPASVINPKLGSSKQSFINPYNGNQCKFGDPTTLAEAGSVQMELQYLSHITGDPKYAAAADRSIAKLLSLAVKSKDKPENPLFPVDVHPREGRFVTDRISMGSGGDSFYECILKQAILRPLSAGHLRSIFQNVTVSAIEKVGAEVDGLSFLGQCSVTSPETMKRMEVNETSASLFCRDVIMKHLACFAPAMLVLAYNEDRSQTAYLVEAENLMRTCMSMYQVTQTGLAAEQYDIKVKPTKLTPTVRQKYSLLRPEAVESAFFLWRRIYRDFGWQFFMSLEKYCRRSFQGGGYTAILDVDHAASAGSASDANRMDRLDSFFFSETLKYL

SEQ ID NO: 762 - protein, 600 aa, Guillardia theta
MAWRYGSKRTERLLLLLLLLLLSLTRCSPHLPDAPSLPPPLPPQRSLALPAPLTLTLASRRAQVREAIRHAWSGYMKYGRLGDDLKPVSRGVDNWMNARLTLFDSLDTLYLSGCQDLFHEAAQQVLAGGVPGDAIFPSKVFEYHIRIVGGLLSVHSLTGDARFLDLASRAADNVLEAMQNPSGLPYMHFRFVDRKRRPVTWLVSRTMDFIRASYDSAIWRNSLVGIGSMGPELRYLTRETGARRYEEAADRVLAEIHAAWKKLGGRNSSKPLPLWWDTPPRLSRSYRPLFNQLEGSEATLGSGGDSFFEYLLKEQLLQSSSRSQLVDMYEWLTSRLLDGHANQLIRRVHGVDFLVNRRCDYEHLTCFVPGMLALGASQLKGNRSSQLSLARRLMESCIYLYQASPTGLAPDTGSVCGDQFTANSPEYLLRPETVESLFILFRVTKDGRYREIAWEIFRSIEKYCKVESGGYSGLVNVNDVNGSKNDNMPSYFIAETLKYLYLIFDDAAVSLDDFVFTTEAHPLARYNRCDRQGVSRYHSECVSSSIDLFLLSPENLMLLLLLLTCLHRCRCVSLAWLKRALVQRIRSFLKRRRLGRHHMV

SEQ ID NO: 763 - protein, 413 aa, Phaeodactylum tricornutum
MRLWKRTTSGVPPPRRRRRGGREERLAIGLLLTLAVVWGTVLVGTLVALVASPTKSVPTFPTVPTDSRPSAAFVVSDAPGAYESPLLVFTCRRDQYLRETLRDIWNYIPTDCSVGCPLVISQDGNDPAVQRVVREFTDEFATKNVPVVHWTHTSALRGGTNGYQALAIHYGWALRRVFDGQTLSGSVHGAKHGTPKRVIILEEDLHVAPDFFDYFAATAPLLDHDSSLLAVSAFHDNGFAHNVRNASRILRSDFFPGLGWMMNRRLWVDELQSKWPGGYWDDWLREPAQRQDRAILRPEISRTYHFGTEGGTSSNQFGSHLSKILLNRETVDWSKAVDLEAQLRPEVYDPAYWAMVQASTLTYTIPDALEQAKKSNARLQYTTIEQFKYLAHKLKLMADEKANVPRTAYKGIV

SEQ ID NO: 764 - protein, 636 aa, Micromonas pusilla
MNKSSGSHGRTGKVKPTFRVPLKIASLRFSVQKSRLYPLQRGLPRIKSCRLFFYLFVAFAIARVGIIYVDRSKKNLIVKNSLVASTSKYARREGEFLLQDVMDHHRGSAWKKTRQLVRGGSRSAGASNAPLQSRAGTTGGHRNPRRADELELQTAEHEPVERVAREDSSEKLVDGDTSQGHVESMAVLVVAYNRPDYLRQTLDSLAKVSRLSDISVYVSQDGFDEGVARVASEGQLRGLGKPQTRGYEHWQRERIPQLGQNQPGHAWLAQHYKWAIDKIFIDRAHSHVIIVEDDMLFSPDFLVFFKQTAHLLARDESLWCISTWNDNGLASHARDPLRLFRTSYFPGLGWMMRRELWNEIGSIWPKEHWDHWMRLNTTSKGRECIVPEVNRNFNIGRTGANMRRDTYDRYLKRMSFNVLDINHYGNLAYLDRDVYRQRLQRLTQSAAVWPWHQHQHSILSSLQHWLKTEKGDNAGENAVLALYRMENYELLANALDLWPYPRGHSQHAIEVSIDGVTIILADERSCPYLPSHLRVRPSRGLTPVAAVQGQTCDAACRYNHMKCHAPDFWFLNSCEVLAKFFPCEAGCALVLGDDIPNYVVSNRMDTYQKCLVSERQATCAASHRATTRLCACVPST

SEQ ID NO: 765 - protein, 339 aa, Micromonas pusilla
AAVVIMACDRADYLERTVASVRAALGVRPGDVDKFPVFISQDGRHKATRAFAEGPKAKDFHWMQHLEDRPPTTRTRFRWDSVAYYRIAAHYKWAMKTLFDDLGYERVIVLEDDMELSPDFFGYFEAAGKVMDADPSVYTVSSWNDNGQKIHVSDERRLYRSDFFPGLGWMLHKALWRELAPKWPDSYWDDWMRLSDVRRGRESIRPEVCRTFNFGEVGSSKGQFFRAYLREIKPASERIDWASQSLAYISNGDAYEDQVRRTLASATIIDSPTQVRLVPPENAATNVYKVIYASERDFNRLAKRFGVFAEWKDGVPRAGYRGVVTFKMYKGRATVMLVP

SEQ ID NO: 766 - protein, 386 aa, Micromonas pusilla
MDGDDALPDGASLRDRPTAYAAVVVIACDRVKYLTRTVESIARAVASSPDPKKTREEFPLFISQDGDDARTTTYARTLEGKFYHVRHRQERLPKLRDGDSARHRAYYRISAHYKHALGRLFDDLGYERVVILEDDMDLAPDFFAYFRRLGDVLERDPSVYAISSWNDNGQKSLVKDERRLYRSDFFPGLGWMMHARLWKELRPKWPDAYWDDWMRQSAVRLGRETIRPEVCRTFNFGEKGASEGQWYKTHLANVKLASEKVDWGNEDLSYLDADAYERAVAEAVDAATPARDPSQITRAEITNPKGVFKVLYKDEAEFRRLAAKFHVFPEWKDGVPRGGYRGVVHLKMNDGRHEVMLVPRDAAKVTKTFAEYLASVDGGKAEVLGL

SEQ ID NO: 767 - protein, 316 aa, Coccomyxa subellipsoidea
VAAVVSVVFNRPDYLKRHAASLLAVHGSDPTFRQKFPLFFSQDGNMPHAATQEVAQSYEQISYLHHLERVAPVVRQSQEKIEYYRIAAHYKFILRTIFDCFRYPRLIILEEDMELAPDFFSYFEALHPLLDTDPSLMCISSWNDHGQDKFVRDAHQLYRSDFFPGLGWMLRNELWQELKGGWPGSYWDDWLRQNGTRKGRQCIRPEVCRNYNFGRDGSSKGMFFSQFLEPIRLNKEPIDWLAADLSYLQLPRYDEEMAATLAAAKEVGGADEAAGVAGDVVLRYDSQEHYERVGGGFGMLLEWRDGVPRGAYKGVV

SEQ ID NO: 768 - protein, 229 aa, Chlorella variabilis
LQDDMELSPDFFPYFEATAAVLDADPSLYCVSSWNDHGQDRFVANATQLYRSDFFPGLGWMLNRRVWESIRSMWPRGYWDDFMRLDATRQGRQCIRRAAVCRTYNFGDIGSSSGQYFRLFLKPIKLNSGTGAQGRPWCSAQMDLGFLEQAQYQQRFEAELAAAQPLRGLDEMATAVPGRDYVLRYDSQQAYEALTGKLRMLREWRDGVPRGAYRGTVAIRNPAGARIFL

SEQ ID NO: 769 - protein, 723 aa, Galdieria sulphuraria
MNNKLLQHIIILSLTWNNMFYYCSSLLSDLNLLRNNKAYSIVLITNCQRDSISLTLQSLYRLPQIEYFSVFISMDCNQTNKNIQNWIEQKYQKIARGILYFPRHRYPKVSRNNSYSQISCHLHFAIQQVFEVHNYSSLVVIEDDLLFAEDFLLLFLETYPLLMTDKSLLCVSAYHDLGLKQFSWKHNRLKRVQGFTGLGWMLSRDKWLKELSYIWPLYPFSGWDHWLRMYQRIHHLDCIVPEVSRSIHQKVSGSHLSHKEWQRRFSHLLFYDNESVDTFGNLDYLQREVYDREIQMLLTCASKLHSLSSNILKQSGENIQIIIPCTLPKGNRYWRHWFRFLEIPLSQEIESFYEGILLFPMGFQTILFICTNSPFYETKRLSTNFGSYYIIRSHENASCSEACDKVFLGKYRCQSETLAQIDSFAIINTYFDCSKGFQLVTRSWAPGCLFPDDRHQAAVECVCVMHNQWAIGYHPYSCDQKAPRLRRLYFFQALSKDLVEDERKFMASSSVALRQKLLEELLREALESSGKTLEEQETLVKIKLRDRGLKLQENQQRQQSKSSKRKKQTHLTAKELRGNHLFAIPKKEQCFQAFIPLHWLWLGYARKVLSNSGILSARENCDRSQLHSHSGIEWLYRMDLHGAILTVIRSKAPQQVGNWGIVLQETSNVFKLIRPDNTVVAVPKEISDWGCRIDEFCFVLHGKAYRMKSSERSVKKLKRKISD

SEQ ID NO: 770 - protein, 738 aa, Galdieria sulphuraria
MNNKLLQHIIILSLTWNNMFYYCSSLLSDLNLLRNNKAYSIVLITNCQRDSISLTLQSLYRLPQIEYFSVFISMDCNQTNKNIQNWIEQKYQKIARGILYFPRHRYPKVSRNNSYSQISCHLHFAIQQVFEVHNYSSLVVIEDDLLFAEDFLLLFLETYPLLMTDKSLLCVSAYHDLGLKQFSWKHNRLKRVQGFTGLGWMLSRDKWLKELSYIWPLYPFSGWDHWLRMYQRIHHLDCIVPEVSRSIHQKVSGSHLSHKEWQRRFSHLLFYDNESVDTFGNLDYLQREVYDREIQMLLTCASKLHSLSSNILKQSGENIQIIIPCTLPKGNRYWRHWFRFLEIPLSQEIESFYEGILLFPMGFQTILFICTNSPFYETKRLSTNFGKNCDNERSICNYGQGSYYIIRSHENASCSEACDKVFLGKYRCQSETLAQIDSFAIINTYFDCSKGFQLVTRSWAPGCLFPDDRHQAAVECVCVMHNQWAIGYHPYSCDQKAPRLRRLYFFQALSKDLVEDERKFMASSSVALRQKLLEELLREALESSGKTLEEQETLVKIKLRDRGLKLQENQQRQQSKSSKRKKQTHLTAKELRGNHLFAIPKKEQCFQAFIPLHWLWLGYARKVLSNSGILSARENCDRSQLHSHSGIEWLYRMDLHGAILTVIRSKAPQQVGNWGIVLQETSNVFKLIRPDNTVVAVPKEISDWGCRIDEFCFVLHGKAYRMKSSERSVKKLKRKISD

SEQ ID NO: 771 - protein, 483 aa, Thalassiosira pseudonana
MATNLDSTTATGQQSSSSLLARPHIYNPKEGSRVGWLIRQKIQRAQMRIQKPVPLLDVSQMDSPVLIFTYERAEYLERTLWAVFEHHPAQQQQQQTTNENIRSDGETIKRGRIVGAPIIISQDGNNADVAAVVETYRQLFEIKLGIPLYRIEHPRPRTPSNNEYNFYDTDWALPYKMLAQHYGWGLEQTFSGDVYATNTNKHSRSISQPPMPKRVIILEEDIEISRDFFSLMNATADMLDSDSTLFAVSAYNDNGNEGLVSDPNRLVRSDFFPGLGWMMPRSVWDGPAQQPEARLKGSWPEGYWDDWIREPNVRRGRQVIRPEVSRTFHFGNVKGASQGEFIKKLSKIQLDEVNVRWEDQDLSHLDTTAFAKDYWDRVSRAKIVASDVEAKKEVAFCDVRIEWNEWKQFKLLATKFDIMKDEKAGVPRTAYEGIVEIRYGGGDFFIYLTPPYLSDVAMPTDFGSKAFMGFTKETLLQRLGISD

SEQ ID NO: 772 - protein, 529 aa, Thalassiosira oceanica
MQQQLHLHRKRGGGNPALIVFRGIIVIVICCSLFWISMILHLMATANEQHGRQAHSANSLLMRPQFFRGKRSHIRNELNHKMQRIEQHLLDRPVELAGAASLVSPLLVLSYKRADYLERTLWKIFSNHPANNGNQGPTEDKGRIVGCPIVVSQDGPNSEVQDVIETYQQLFEYKLGIPLYRIQHEREPNEMYEKDLFEPYKRLAKHYGWAIEQVFSSDAYTAGAKHSRSDLSDRTPPKPHRLIVLEEDIEVARDFFSLMNATADLLDLDDTLIAVSSYNDNGRSDLVADPKRLVRSDFFPGLGWMMNRAVWDGKVGHPGLKDGEGFAPGGFWDDWLREPGIRRGRQIIRPEISRTYHFGNVDGASEGEKNNMLNKIELEESHAKFENLPLTSQLEGRAFAAEYWSRVSHARKVETAGEAKYYVMASHVRLTYNSMEIFRQLASQFDITEDEKAGVPRTAYEGIVEIRYGKGNYFVFLTPPYLDEACDKGGGSMPRHFGNKAWKDYTKETLMETLGVNDISFDERPGINW

SEQ ID NO: 773 - protein, 382 aa, Fragilariopsis cylindrus
MPEGESVRLPIISSPFHPHTENIVSSGSPLLIFTCQRANYLNRTLENVYASISRPQHDEENEECRFGCPIIVSEDGEHADIRTIVLSYRKKFEVIGIPLVHMHHPQKKKILRSTSASYVALARHYGWALSEVFAGKAGDSSFSLPHRVIILEEDIQVAPDFFSYMESTSSILDNDSTLFAVSAFNDNGHVDNGDPKRLLRSDFFPGLGWMMTRDLWINELQKNWAPDGYWDDWLRDSTQRKGRQVIRPEISRTYHFGTEGGVSGNQFGSILEQVKLDEKPIRWEMEDLSYLENSLYKTQYMELVTNSKFATTLDEAEQMSKTGNVRIEYDSYTQFRIFAKKIGIMDDEKAKVPRTAYNGIVETRRGNSLLFLTPKGGIVGYK

SEQ ID NO: 774 - protein, 410 aa, Emiliania huxley
MRRSPGSSREPRLTTSTAVLAVASALILLMLSFNARLYFSAACDQRLQQLADEKDRELQRLARRDLVAYVDWTPGALTPPRIAVLVIAYNRASYLDRALGSVMLRHPGGANWPVYVSQDGENDEVARVIAKHGARRLVHPRRQLDLSRAEKFLKKAPGYAYLSVHYGWALRTLFADAARYEGVIILEEDIEDDTLLAVSAFNDNGQPRYSSDTSALYRSDFFPGLGWLLTRRLWAEIGAGWPEERGFWDDWMREPPQRQGRASIRPETSRSRTFGQKGTSLSQFYIKFLAPIQFSDQAAPAWAGRNLSFLLKAAYDPPFAARVAAAREVELRRVIDRSFTASGGGDVVVRYSTPKVLLGFCKQLGIMEDLKAGVPRTAYHGVIPLRVGGVMVFLAPSFAVDQDITQRKPP

SEQ ID NO: 775 - protein, 442 aa, Guillardia theta
MKSSKSRGFQGILVICIVVLLLLANLMWMKKVQSDQALHDAEKRIVDLSSKIKVLQGSLSTSQVEQETDHSRVKTLMMRINELESKMGFSGAKDTSSALQGSPNAPPPSIVKGSTAGRGESESERREKSNEVSASFPSSVQQSAGGEEAQVVPIIIFACCRAKYLDRTLSIVLERLPKQSKVKFDIIVSQDGNDPSVKSLMHTKYANIKFLEHMEQVDLSTAGPQEQASYYRIAQHYGWCFSKVFADQRYEWAIVLEDDLEVAVDFFEYMMAAAELLKKDPTLWTATAWNDNGFPSYSHDPHKLYRSDFFGGLGWLLTRKLWQELGPKWPKAYWDDWMREPKQRMGRACIRPQISRTVTFGKEGTSNGQFFDSHLSKMVLNSVHIAWTTKDISFLLKENYDEQLRRQVEEAPLVGLHDSRATGKIFYKDHPSFKVLAQSRTL

SEQ ID NO: 776 - protein, 712 aa, Phaeodactylum tricornutum
MIESEEHRKLSEQDLDREGLWEEHFQSHQDSKPFGPMSVGMDIDFPESNHLYGIPEHASSATLKTTFGENAHFKEPYRLYNLDVFEYELDETMALYGNSVKTGTTGVFWFNPTETYVDIASSSGSTGTHWISESGIIDVFLLPGPDPSSVYHQYATLTGTTPTPPMFSLGYHQCRWNYKDEKDVYMVHGKFEELDYPYDVLWLDIEHTNGKRYFTWDSSLFPDPKTMQKTLADQGRRMVTIVDPHILRDNNYYIHKEATAKGLYIKDKQGEKDYDGWCWPGSSSYLDFTDENVRSWWADQFSYSRYEGSTPTLFTWNDMNEPSVFNGPEVSMQKDLRNLHGDEHREWHNLYGMLFHRATGEGHIRRSPSEDIRPFVLSRAFFAGSQKYGAIWTGDNTADWGHLQVAGPMLLSLNTAALSFVGADVGGFFGNPDAELFTRWMQAGAYQPFFRGHAHHDSKRREPWMYGEETMQRLRQAALWRYQLLPFWYTVFHEAEISGMPVMRMMWMQYPETEAIFGVDDQYLIGADLLVKPITAAGVSEVEVLFPTDHLWYDVKSLQIVCSTIASMSVESRTISSAIDEIPVFQRGGSIIPRKLRLRRSTTTMKTDPYTLFVALDDSYQASGTLYMDDEETLGYSKRAECADASISADLSEGAAEDRMIERIVIMGFPSTPKAVSVNEESLDFSFNKSSNVLVVRKPEVSALRDWSIKIV

SEQ ID NO: 777 - protein, 903 aa, Chlamydomonas reinhardtii
MRRAIALGVGLALLGLLLPGSLAFKENEFKKCAQTSFCSRNRNVQQGANFEIVPASVTLNTATLTATLMNKQASKHLQLTLTAHADGFVRLLIDELPSVGRYQVPSDILVSGWETRKAAIKEESRSANGVVLVTGDTKLELNYAPFTLAVSVKGVPALQLNSRNLFNFEHRRPKQDSDPAGYWEETWMGHTDTKPKGPEAMSLDLVFPGFSHVYGIPERATSLSLKATNGNAPYGEPYRLYNLDVFEYLDDHPFGLYGSIPVMLAHKKGLTVGVYWNNAAEMFVDVVKGRDVGTQWIAESGVVDLFVFTGATGPAVLASYAKVAGTTALPQLFSLGYHQCRWNYKDEADVKAVDGGFDAHEIPYDVLWLDIEHTNGKRYLTWDSSLFPNPVAMQEDVASRGRKMVTIVDPHVKRDSSYYIFSEAESAGHYVKNKHGSDFDGWCWPGQSSYLDVTSPVVRNWWAQQFTTDKYQGSTKHLYIWNDMNEPSVFNGPEITMHKDNLHYGNVEHRDNHNLFGVYYHMGTADGLKLRGSQNGDRPFVLSRAFFSGTQRVGPIWTGDNAAQWSHLKVSVPMLLTLGLTGLPYSGADVGGFFGNPDAELMTRWYQLGIYYPFFRGHAHLETQRREPWLFGPDVTARIRAAIRGRYALLPHIYTLFRAANTTGQPILRPLWFEFPEQEDLYAEEEEFMVGSSMLVKPVTAPSTFTVDVTFPQGSRWYDATTGAPVPPKTKTQRVEVNLNGIPVYYRGGSVVPRRERPRRSTAAQLADPYTLVVAADDKGEAEGQLYVDDGRSFAFQRGLYLHRDFKFSGNKLTSTKHVEPGVPDGTLTVPTTIERVVFLGLPAAKKGYKAVISDGVSGAKHTVALEAGPLSMAAAPDSTQALVLRKPDLPVSHDWTVEIVQV

SEQ ID NO: 778 - protein, 898 aa, Volvox carteri
MRAAISCLLLVTLGISQLATAFKENEFKKCAQTSFCSRNRNMQQGANFDIVPGSIVLNTATLTATLLNKGFDKHLQLTVTSHSDGFIRVLVDELPDVGRYQVPSDVLVSGWETKKLAFKEESRTSSAITLSGGETKLVLNFQPFSLAISVKGVPALQINSRNLFNFEHRRPKQENDPAGFWEETWMGHTDSKPKGPEAISLDLVFPGFQHVYGIPERATSLSLRSTNGAAPYGEPYRLYNLDVFEYLDDHPFGLYGSIPVMLAHKKGLTVGVFWLNAAEMFVDVVKGRSEVGTQWIAESGILDLFVFTGGSAPAVLSSYARVAGTTALPQLFSLGYHQCRWNYKDEEDVKEVDGGFDSHEIPYDVLWLDIEHTNGKRYLTWDSSLFPSPVAMQEDLASRGRQMVTIVDPHVKRDSGYYIFSEAEKAGHFVKNKHGSDFDGWCWPGSSSYLDVTSPAVREWWAQQFTLDKYQGSTKHLYIWNDMNEPSVFNGPEITMQKDNLHYGNVEHRDNHNLYGIYYHMGTAEGLKLRGSQVDPENGDRPFVLSRAFFSGTQRVGPIWTGDNAAQWSHLKVSVPMLLTLGLTGLPYSGADVGGFFGNPDAELMTRWYQLGIYYPFFRGHAHLETQRREPWLFGPETTARIRTAIRGRYTLLPYIYTLFRFANTSGLPILRPLWYEFPENEDLFAVEEEFMAGPAILVKPIVAPGVSSVDVTLPVGARWYDALSGAAVPARSRSQRVTLDSIPVYYRGGNILPLRERPRRSTAAQLADPYTLVVALDDKGEATGSLYVDDGRSFAFQRGQYLHRDFTMKSLKLSSSKHVEPGVPSGALTVPTTIERVVFLGLPASKRGYKALIGAKHAVPLEPGPLTMLAPQYENALVLRKPGLPVSHDWEVEIVAL

SEQ ID NO: 779 - protein, 952 aa, Ostreococcus tauri
MSVDRRHRAMGTGARRGRRTGTATATRAGWALALCVLARACARGRAFKGQDFKTCETSSFCARLRDGVARDDDRNHVLGHGVDVRAVVRSKSARVVELDVVNVGAVGEEGDARARVAVEAFGSGAIRVRVDDVQKPRYVPKDVLVREVEFDVSARALLAVTESAGEVMIEARETGARARVRLQPFAVEVFAPGSGSIPSAVFNKRGGFAMELAREESGEWSETFNGHTDTRKGGPTGVAFDVTFPFASDVYGIPERATSLSLKSTRQYESASKGWFKGGGAASESERNESTLGEPYRMYNLDVFEYLDDSPFGLYGSIPMMTAHGISRSSETITSGVYFHNPSEMYVDVNVDGSNGVHTKWMAESGAIDVFILPGTTPGKVLQQYTALTGTTSMPPLFSLGYHQCRWNYRDENDVKEVDKGFDEHDIPYDVLWLDIEHTDGKRYMTWDKAVFPTPQRMIEDLSSRGRKMVTIVDPHVKRDEAYPIYKEAKDKGFYVKKNDGNTDFDGWCWPGSSSYLDVTNPDVREWWAGKFSLNSYEGSTKDLYIWNDMNEPSVFNGPEITMQKDLIHHGGVEHRDVHNAFGMYYHMATAEGLKRRNDGNRPFVLSRAFFAGTQRVGPIWTGDNAADWKHLAVSLPMVLTLGVSGLTFSGADVGGFFGNPDAELMTRWYQVGTYYPFFRGHAHLETKRREPWLFGEENTAIIRDAIRERYALLPYIYTLFEESHRTGAPVMRPLWYEFPADADVLKTQDAFMLGTAMLIRPVLEQGAKSVSVYLPKGIWYEKRSGVRHVGPKSFDVAVSLSDVPVFLRGGTIFVRKDRARRSTTAMRGDPLTVIVALDENGRASGTYYADDGESYEFASKKSAFMRRRLTFSNNEFNVAGAGAEDGNAGDAKSFIDHSLIERVTVHGLSATGDVATCAATRDSFDVVRVGAVANIRRPNLPISRDFTIAVQ

SEQ ID NO: 780 - protein, 796 aa, Micromonas pusilla
MGFSSETPVGSEVKVVIEHAPVKITTLVDGVEAVVFNANGAFEFERRKTKSEEDAPPPEPSPETFNSHTDSRPNGPMALSFDITFPDASHAYGLPERATTMSLRETKAADGAIATEPYRLYNLDVFEYEHDSPFGLYGSIPMLLGHSSRPPRVHGVYFNNPTELYVDVTKGGSSGGISSHWMAESGAFDLFIFPGPSPRETMRQYSMITGGTAMPPAFALGYHQCRWNYRDEADVAAVDAGFDEHDIPYDVLWLDIEHTDGKRYMTWDGATFPTPRRMIEDVASRGRKMVTIVDPHVKKDANYPVYKEAESKGLFVKQKDGVGDFDGWCWPGSSAYLDVTSPAVRAWWADKFSLKNYQGSTKDLYIWNDMNEPSVFNGPEITMQKDLIHHGNVEHREVHNAFGMYYHAATAAGIEKRNDGERPFVLSRAFFAGTQRVGPIWTGDNAADWNHLRVSLPMVLTLGATGLAFSGADVGGFFGNPDGELMTRWYQTGIYYPFFRGHAHLDTKRREPWLFGEPYTALIRAAIRRRYQLMPYLYTLFEEAHRDGAPVMRPLWYEFPNDPHAAAKEDAFMLGPALLVHPVTTQGASSVEVYLPAGVWYDYDTNEMHAGPKTFSVAVTLADTPTFVRGGHVIVRKDRARRSTRAMTHDPFTIVVAPDESGKYAYGEVYLDDGKSYAFEEKDAFSRRQIIFEDGDSLVCAAKWRGGSWGWTTHDAEQKHLEGDPLAFPEIAAEVERVIVLGPRRFGEDAEVRNKRKEIHLVSASGKEGSPAAATAVKKPGVVLAQDWSILFSVAD

SEQ ID NO: 781 - protein, 916 aa, Coccomyxa subellipsoidea
MGEEMINPSRKGNHSFLTSFFLIFLFSSLQFQLSTSVKVEDFKKCTDAAFCNRLLGTRDEGYYIDPASVQFSGPSVTARLLNKAKGTDVTLTMKAYKGFVRLLVNEDASKKRFEVPGVLMHDLGSREAIWSKKAQTAQSLLLQLEDAEMQLQYSPFQIGISIKGKPVMSFNGRQMFNFEHLRQKQEGDPEGWWEETFKGHVDSKPRGPEAISFDLEFPDTQHVYGLPEHATSLSLNPTVDLADNATSEPYRLYNLDVFEYAPESPFGLYGSIPFLWAQKLGVAVGAFWLNAAEMYVDVGKTEEGTFTNWVAESGILDLFLLLGPTPAKVSEQYAQITGATALPQYFALGYHQCRWNYRDEADVRQVDAGFDAYDIPYDVIWLDIEHTDGKRYFTWDKSLFPDPVKLQEDVASHGRKVVTIIDPHIKRDPGYYIYQEAEQNHYFVRDKDGKDFDGWCWPGSSSYLDMLNPEVRAWWAQQFALSKYKGSTPNLYVWNDMNEPSVFTGPEITMQKDNLHWREVEHRNLHNLYGALFHQGTAEGLIERGKAVYGSDADRPFVLSRAFFAGTQRVGPIWTGDNCADWKHLRVSLPMIMSVGIAGLPFNGADVGGFFGNPDAELQTRWNQVATFYPFFRGHAHLDAKRREPWLFGEDATRRIRDAIRARYVLLPYIYTLFRHANTTGLPVMRPLWYEFPEVEATHGVDDEFMLGPALLVSPVLEEGAESRAVFLPGKGPWYSARTGEPVKPDAGGALTVPVTMDSVPSYLRGGHIMPLRERARRSTAAARKDPYTLLVALDSEGQASGDLYLDDGSSFAYKRGLFAHRLFSFKDGMLSNQELPGNPSPPRYSTDLVIERIIIVGLGHPAKSFSVKEVGTGKVLQTGAGPVVQEAGVPELALVIRKPELPVTGDWSIQLSVTA

SEQ ID NO: 782 - protein, 515 aa, Chlorella variabilis
MSRGAAVLLLLLASAVATVQGFKAEEFKKCEDAAFCKRLRGNTSEAFVLLPDSVKVEGARVTATVQNTQNANGTFSLVLTAYGDTLRLFIDEAPEKGRWQVPDVLLPGLEQREQAWEVVKKSHTKLRVRCGAAEAELRTSPAQLEVSVGGTPALVWNAGKQFIFEHLREQQEGDPEGWWAENFKTHHDSKPKGPAAISFDVHFPGTRHLYGLPERASSLALQPTRGPEGPLSEPYRLYNLDVFEYLHDSPFGLYGAIPLMLAHRPEQTVGVFWLNAAEMYVDVSQDEGGASTQWLAESGVVDVFVFVGPRPADVARQMAALTGGSALPQMFALGYHQCRWNYKDEQDVAAVDGGFDAHNIPYDVLWCWPGSSSYLDMVNGEVRDWWSHQFSTSVYSGSTKHLYIWNDMNEPSVFNGPEITMHKDNLHLNGTAEHRDVHNVYGYFYHMATADGLRKRGFEEWGPDGDRPFVLSRAFFAGTQRIGAIWTGDNEATWEHLKVSVPMLLAINIAGLPFS

SEQ ID NO: 783 - protein, 970 aa, Cyanidioschyzon merolae
MQRARFRAGSQYPLWSTVGFIFVLCFLIWELAGVQAAERGKYARCSTQSFCAYHRQRREQQTSQQELAANATAPGTRCRLREPEPFRLQKTSSSVLIFELLQREANDSGTLSQLQLEVGAVTHSIFSIRVREPPPSDTIQLGLLRRRKQHASVSKYERYSPVEDVMMYREPWLQLERLAASTATSCPYVSSAAWLSSDTETVIVTASTSHASTEPVYNVLRVQHEPCRIALFNNVADWCALLQNSTATTTRPSLVWNAAELLAWIPLDANTTAAGSVAADVAFPRAIGLYGLPEHALDLRLPTTCTREPLRLYNLDVFEYELNSELGLYGSIPFILALNGSAHTVGALWMPASETYVDLCPLLDQERGTAMPHAHFISERGIPEMFVFAGPSPVEVSQQLALLTGHAPLPPVFALGYHQSRWNYRDEADALHVDGQFDANDIPYDVLWLDIEHTDNKKYFTWDGAKFPDPARLQQTLFEKAKRKLVTIVDPHIKAEPNYSLHERALKEDWYVRSGDGVSIYEGWCWPGKSHYPDFMDPRVQTGWSSCFVPSFYHGMTEHLHIWVDMNEPSVFNGPEGTFPKNVRHRLGALEHSDIHNIYGHMVHRATFEGLYRGRQGNLRPFVLSRSFFTGSQRFGAVWTGDNAAQWSHLAASVPMLLSISVAGIAFVGADVGGFFGNPQADLLTRWYQAAAYQPFFRGHAHLDTKRREPWLFGEPYTSLIREAIQERYALLPYWYVLFAAERTLPVIRPLFYVFPDESSLAGVQSSWLLGDALLVAPVLEAAPSTHRITLPGPASLCWYPVLPRTRRLFSGEHLVHRGQDTLVYPKPALSSMYVFQRGGSIIPRWERQRRSSSLMLGDPLTLHVALDAGFQARGMLYLDDGLSYGYQRGDYCFWRIAAMGQRLANGSTSLQLRLTLQALDALPPPSNLSRCAHVPLERFVFYLHAGERVVVRKPTLSVSGDVTTWQGVC

SEQ ID NO: 784 - protein, 945 aa, Galdieria sulphuraria
MRIIPSKVAIIIIIFFLLYIVSRCSGAKWADLCKCEELSFCRRNRVTDQTPLEGNLLFPETRVREGSVKAQQVKVKGVVGDSLYAILESRVGNVSTDLVLQVFPLTGGSFRITIAEEQAPLLRFDAKDALKEPFPLGHFDLSPYHDVEATLLWNEGKKLILKYVPFELLVFSNNQSLYPDIVVNHHRLTKLEVLQNHSNHFCAALEETHLANDNISIVENMSTNTKEDSLLQLYCQNAFEETVHGHLDQKKRGLEAVSMDIMFPFGQHLYGLAERATDLSLSFTKDSLYGSVYSEPYRFYNLDVFEYETQKPLGLYGSIPVLYTLEEKSTSGCLWLNAAETFVDIFPSNWSQESSLASHFISETGLLDVVLFPGGKTPQDVFNQYLLVTGRPAMTQRFALGYHQSRWNYRDQMDTLAVNQRFDQFNIPCDVIWLDIEHTNGKRYFTWDMEKFPDPSSLLKRIGDNGRKLVTIVDPHIKVDNDYFVYREAKANQFFIRKQNEEEEYSGWCWAGLSSYLDFVSKKVRNWWSTRFQFRYYPHFGDNLYTWIDMNEPTVFDGPENTIPKSVIHLDGWEHRQVHNMYGFYMHKATYDGLLQSRNFSDRPFVLSRSFFAGSHRYGAVWTGDNQANWEHLRYSIPMILSLQISGMILSGADVGGFFFDPDPELLIRWYEVAAFQPFFRAHAHEDTRRREPWEFDAQTTTLIRKAILRRYELLPYWYTLFAASSSVNCEADFETCGPPMRPMFWEFSYDKETWKEQTEWMIGNALLVAPILEKDSLFRTVYLPPGNVSHQEQWFDLFSTDSKKRSIAQRGFVQVNAPLGRHIVFQRGGTIVPFRNRTRRSTVCMERDPIGLRIALDHDGKAKGLIYLDDGRSFLYESGHFRLAKYLWNSTGTLQVMIHPLGNKPFVGSDIIIEQIVVYGMKQQPKRAYVSSQLNNATLHFSST

SEQ ID NO: 785 - protein, 859 aa, Thalassiosira pseudonana
MLQFEPFAVYFFRGNDDSPPMIVAGTSGLTHFEVRRSKECSESMNDGTSNQRKLTEDNVEDDVDHHGGKEIVGYWEDGLAIYADGSREERREDTIAATEEDDEGIDKGEGREQRRLDEDDYDTDGMWEEKFGDHRDSKPHGPMSVGMELTFPSSNHLFGLPEHASSTQLKTTVGSGGHHYYKEPYRLYNLDVFEYELDETMALYGHIPLVVSQSEKMGTAGAFWFNPTETFVDVEETPEVSTKDVESRAHFMSESGIVDLFLLPGPDPAELYSQYARLTGRMPLPPMFSLGYHQCRWNYRDEADVYFVHGKFEELDYPYDVLWLDIEHTDGKRYFTWDHKLFPNPAKMQQQLGSDGRRMVTIIDPHIKRDPNYYIHKEATSLGLYIKDKNGDKDYDGWCWPGSSSYLDFTAEKVRDWWADQFQYNKYKGSTPELFTWNDMNEPSVFNGPEVSMQKDLLNLNKQEHREWHNLYGMLFHRSTSEGLTKRNEGTNVRPFVLSRSFFAGSQRYGAIWTGDNGAQWSHLEIATPMLLGLNVGALSFVGADVGGFFGDPDAELMTRWMQAGAYQPFFRGHAHHDAKRREPWMFGDETMIRLRRAAMTRYALLPYWYTVFWQAGVTGMPVMRTMWMQYPNIPSLYSIDNQFLVGSDLLVKPVTTPGATTSEIQFPLADSWYDVDTMQRVSVEGKANSAVTKIVDSGIDKIPVYQRGGSIIPRKLRLRRSSYLMVNDPYTLYIALSANFKAEGTLYMDDETTFDHENRDDYGVANFSADWGDASIAIQNSVIIGSSDGLTAKARDARMVERIVVMGVPKKPHSIELFVDDASEVAAIEFQYDASSEVLVIRKPEISALDSWTMMISK

SEQ ID NO: 786 - protein, 777 aa, Fragilariopsis cylindrus
MVIDEENKDVDQSEKEIVGYWEDGLAIYADGTREERKVDKNQVDRRQLSELELDREGLWEEKFQSHTDHKPHGPMSVGSDITFPGSKFLYGLPEHASSTVLKNTVGSNAEYEHPYRLYNLDVFEYDLDVPMALYGAVPLLVSQSVKTGTSGVFWFNPSETYIDINDDDSGSKTSHWMSESGIIDVFFIPGPTPKDFYRQYAKLTGTTPLPPIFSLGYHQCRWNYKDEQDVHQVHDKFEELDYPYDVLWLDIEHTDGKRYFTWDKNLFPNPKTMQEKLWSQGRRMVTIVDPHVKRDNGYYIHKDATAKGLYIKDRDGEKDFDGWCWPGSSSYLDFTDEKARSWWADQFAYDRYHGSTPTLYTWNDMNEPSVFNGPEITMQKDLLNLHGDEHREWHNLYGMLFQRSTMEGLIRRNKEENIRPFVLSRSFFAGSQKYGSIWTGDNAAEWSHLEIAAPMLLSLNVGALSFVGADVGGFFGNTDAELMTRWMQAGAYQPFFRGHAHHDAKRREPWMFGDETMVRLRKASMARYALLPFWYTVFHEASITGMPVMRTMWMQYPQIESLYSIDDQYIIGSDLLVKPVTAPGVTDSVVKFPGDNVWYDAESLVLVSKRGKEGTVQEITVPSDIDTVPVFQRGGSVIPRKLRLRRSSHTMTRDPYTLYVALDTDGSASGELYMDDENTFNYVNKNEFASAKFTVEIGGKYGYIRNSATVGEGWKGISEETNKMIERIIVMGVEKHPQSVDEVGESLGFTHDSNAHVLVIRKPELSALVDWEVKITF

SEQ ID NO: 787 - protein, 976 aa, Aureococcus anophagefferens
MRSLLRLALLGVACRAVDKSKFRTCQDTRFCRVHARPAAPPPTYAVNDASVAMADGALRFEVSEGTLAPLVVTVLPHADAGVVNVRVTEAGVSRWEPDDVLLGPFALDGDAKLSKTPAGATLTLGGGGAVAVTYAPFTLSLGPAGGDPLIVVNGKDLLHYERGRAAAAAAPSLGDPSGGDADSHGCEDGFAWNGERCLEIAGYWEDGLARFADGTKEVKTYKAAEVAKDDGDFSETFSGHTDDVPNGPMSVGVDVSFPGSKALFGLAEHASQFALKKTTGGGGYDEPFRFYNLDVFEYDLDVPMALYGTIPLAWAVAPGREKHSTVGVFYDNPTETYVDVGAGPDDTNWDLHFVSESGVLSLFLILPETPLDGFAKYAALTGAQELPPLFALGYHQCRWNYKDEKDVAAVHGQFEALDIPYDVLWLDIEHTDGKRYFTWDANLFPDPATMQDTLAKTGRKMVTIVDPHIKRDNNYDVHKKATDAGLYVKERKHGELKDFEGWCWPGSSSYLDFTAAHVRQWWAERFSLANYGGSTANLYTWNDMNEPSVFNGPEVTMAKTLVNLGGVEHREWHNLYGMYFHRATAEGLMLRDSKENKRPFVLSRAFYAGSQRWGAIWTGDNAARWDHLKVASQMLLSISVCGLSFAGADAGGFFGDPDPELMVRWIQAAAYTPFFRGHAHHDAKRREPWSFGEPHTARMRGAIADRYALLPYWYTTFAAARFAGLPVMRPLWAHHAHDADALLVGDAWLVGEDLLVKPATDAGVSTVDVYLPKGTTWFETHTAAMTKRSGGVLAKGVPAPLDGTAPALQRGGSIIPRQRRLRRSTAAMRSDPYELTVALDDAGEASGSLYLDDFETFGFTGGAFHKSVFTFAGGKLSANAGNDCDARAAALGIAADAGSFAPTNVVERVVVLGLAAPPTAVSQSRAVAADDDAAATLPSACMLRRAMKPSNESKGGLRGSVSSGIKRLWRSIPAAR

SEQ ID NO: 788 - protein, 1006 aa, Nannochloropsis gaditana
MASMGWFRAPFASRPSFPKSDASLLSSPVRKSTSRNVLALGRLTTAFVMISSVCQRTTTVAVDRSKFRKCADTGFCKEFRDVVPGALPRFRVDAASLKHDEHAGFLGGQLLSSDANAKALNFSLQFYNDGTSRLKIKECDPLRERWEPPDVVIEESLDPTAIRVDTSKSDGSLHVEFANDKLLRVQLDPFQVDLLVGGVPALTVNKGGLLHFQAYRAKKDKANAGSGGEESGQKIEEEVVDKHGGKKIVGYWEDGLAIYEDGSREEKPSAEEEAAEARRLQEAAAADEDKWEEYFGGHTDSRPHGPASVGIDVRFPGAEHLYGLPEHASSFRLKTTKGPNAQYAEPFRLYNLDVFEYELDEPMALYGSIPFVASHTAALSAGVFLFNPSETFVDVEAGSGHGDGYQTHWMSECGVLDLFLLPGPTPRAVAKQMTALTGTQALPPLFSLGYHQCRWNYKDEKDVAQVHGKFEELDFPYDVLWLDIEHTDGKRYFTWDQGVFPDPVSMQDSLAAQGRKMVTIIDPHIKRDDNFAIHSEATAKGLYVKDKFGADFDGFCWPGQSSYLDFTDAGVRRWWAERFALDKYTGSTSNLYTWNDMNEPSVFNGPEVSMQKDCRNLAGVEHREWHNLYGMYMQRATAEGLTLRDPKGLERPFVLSRAFYAGSQRFGAIWTGDNKAAWEHLQVAAPMLLSINLAGLSFSGADVGGFFQDTDAELMTRWMQAGAFQPFFRGHAHHDTKRKEPWVYGEPTTSRIRAAVMARYTLLPYWYTTFYIAYAEGLPVMRPLWMEYPTEKATFDMDDQWLIGQDLLVKPVTTAGATSLSVYFPQGLWYDIETLSSISGPATRTVPAPLEKIPVYQRGGSIIPRKMRLRRSSSLMTHDPFTLVVAMNAKGLAEGLVYMDDEHTLKHEKAGEFVLRKVTLADGMLRNVRQGGAEDRPFRNQVERIVVLGWKAKPKAVTLSVSEQGGAEKQATTQRSLEFMYDAKKRVLTIRKPEVMLDEDWTIGLR

SEQ ID NO: 789 - protein, 713 aa, Emiliania huxleyi
MDMRFGGTQHLFGLAEHTAPFNLPSTSGDGAKYAEPYRLWTLDVYDYELDSPMALYGGVPLLLAHAPNRTTGALSLSRSCCSHLLPLSHWLEAAAPSPLTLRGALPQARSERGSTSAYWMSESGVVDVFLLPGPSPQELFAQYASLTGYTPLPPLFSLGYHQCRWNYNDEADVRYVHGQFEELDLPYDVLWLDIEHTDGKRYFTWDSFKFPKPKEMQAELAATGRKMVTIVDPHIKRDSNYKVYQEAHEKKLFIQNKDGAEFNGWCWPGDSAYLDFTSAAVRDWWAGRFAYDVYEGSTPSLYTWNDMNEPSVFNGPEVSMQKDAKSLSGVEHREWHNLYGMYMQRATAEGLLQRNEKRDKRPFVLSRSFYAGSQRWGAIWTGDNACKWDHLVASVPMLLTLGLCGITFSGADVGGFLGKGGGYGDPDAELFTRWFEAGAYTPFFRGHAHHDSARREPWTFGDETTQTLREVAKERYQLLAYWYTVFRHAEQTGTPTMRPLWVHYPADEKTWDMSDQWLVGSDLLVRPVTQQGATSAPVYLPGSQPWYAVRDGTKHAAPATPTVEAPLGAVPVFQRGGSILPRQMRLRRASSLMKLDPYTLVVAPDADGAAAGTLYLDAGDGFEYLDGAYAERRYELAAGVLTSTAVHASDAFTPPNMLERLELLGTKPPGKVLLESGGETRELEATWSEATGRTVVRKPGVPMAADWTIRLVA

SEQ ID NO: 790 - protein, 843 aa, Guillardia theta
MAFKEEEFRYCKDSSFCRRQRKFDGQDDRATYKLHNAHLEDNGVVAEMKNALNPNQPLKLRATIYKSGIFRIEIDEASSAKPRYRVKDVLVGDISQHSSSEGAMEDITGENDGLWEESFKGHSDSKPNGPESIGVDFDFMGAKHVYGLPERGSRLMLGNTRGEGAARDEPYRLYNLDVFEYEPLYGAVPILYSHRPNFSSALFWLNAAETMVDVEDGPDMKRTHWFSESGVIDVFLLSSDTPKGVQMQFASLVGTQFMPPMFSLGYHQCRWNYKDDADVRMVDSKFDEYDIPYDVLWLDIEHTVGKRYLTWDKHLFPDPEGLQHDLASRGRKMVTIIDPHLKVDMGYSVYAEAKRLGFFCKNKDGGDFEGHCWPGTSSWLDYLNPEVRDYWASRFLPANYVGSTEHLYTWNDMNEPSVFNGPEITMPKDLLHYGNVEHRDVHNLYGFYMTMATVAGHKLLRPGRRPFILSRAFFAGSQRYAAVWTGDNGARWDHLASATPMLLQLSLGGIHFCGADVGGFFGNPEPELLVRWYQAAAYTPFFRGHAHIDTQRREPWLFGDVVMGQIRAAIRARYLVLPYLYTLFHMAHTQGLPIMRPLWMEFPGDEVTIAMDDEFMLGEALLVKPVVSANTRSSNVYLPSDKDDIWYPFRNGQTPKEQGVFTSLWSRFRGQTGSLRGQAQAGGKTISVDSGVEQGIPVFQRGGTIIPTRERARRSTSAMRADPFTLHVALNVREEASGSLYLDDGDTDEHTAGGFFLFGLKFQSNQLEYRQTEGSGFKFSHPPPALERVIVYGITKQPARVTLKRKNGGGSELEFIYDKESAMLIVRKPNVPMNEEWSISFAK

SEQ ID NO: 791 - protein, 802 aa, Phaeodactylum tricornutum
MTRFSWSRLVMVVVLAASGSVRIQATPATVAECPAGFGSETMVRLLPSQINDGYCDCPTTGQDEPKTQACSGQDAWPGQPYEPDSTKSHRDPLVFVCPNQSNLSIPPSRVDDGICDCCDGADERPGTCEDNCESLRQAERQVRQVWQDAYTAGSSRRAMELTTFANVRAETLHNLRLAESDVYFLEQEQSQTQQELEEAKIKAWKSRQHVHSLALANLLTAEPGAPFRGMLSVLTKSELIWFITHACQLAGEILDTTESVDGGKTCVPLRLAGLDASLLWQSKTYDLERILDANQGDTDESDQAQNEQWSLLVELLEYNMANEPKIWNQSTLQQMQKTRRRLMEEDADYDSMDYHDDYLGADDDYDYAGDDLDYDYAETETTDDLPAPDDAPTDGKREELMSLIRSQPFSHGRVTFFDESSSLLEKIKAITDAEEQDDKEVDEEVSDSVPPSLDPMALPMVRSQLEQRQRRVQRGFSYAVSAQALLEGLERYAYASEEDEVLDLYSLAMGVINHGQLSTTHVWQILLGIIPELVVENAMQTCVSALASSCPPRSVYRSIGEASVPIPAPLLLEAGEAFCTMHATPNEMEDVCVDSSIGTTDIPSSVPDGLLGYFETKPRDDSDAFSHLFMNLSLNGGTETWKKIEALQERLRKTQEDKKDTEARMGNMEDSIGGKDGPGTTLGVDGELFALKDQCFNVEAGKYIYEICIFGSAAQKEKTGGSTSLGEWIGVDIEAETGRRVWKWGNGAKCWNGPQRSVTAFVTCGSETKVLSAGEPDTCRYEVEVESHIACDESYRMRYGLE

SEQ ID NO: 792 - protein, 486 aa, Chlamydomonas reinhardtii
MRGSVALLLLAGLALCANAQNAIRGLNPDLAAHYSGAGGKFTCISGGKTIPFKQVNDDYCDCADGSDEPGTAACHNGRFYCRNLGHEPKLLAAAFVDDGVCDCCDGSDEVKGKCSNTCLQASAAHRESLKSNIAQYEQALATKADFISQARAFKQKLQTKAATIDQDYAAAQAEVERLKAEVSRLEAEESVQRAAEEAQRAADQAAQEQAAAAAAEHQELNAGSDGHAERTLQEEGQQASEEREETPEERGRRIASQWTNDPEAAGVPGSQEHVNEGQGEGEEHEHHGDYSHQDQHDHEDGDGEYHEPRPDASTPLGEVRAKLYDAEATLREAERDKERIATYLYGNLDFGPEDIFLALADQCFTSSQTRWTYEACIFKHAVQREGYSNSVTVGRWSGFSSDYKTMLFTGGDECWNVGPRSFTVAMSCGNENVLSDGEEPATCAYSAKFTSPALCNDEELIGLRNQLANLEAFEREVAEKIAKDEL

SEQ ID NO: 793 - protein, 503 aa, Volvox carteri
MQALYVLALFAGLALAQTDNLRGVNPDLASHYSGKGGAFTCISGIPKTIPFSRVNDDYCDCPDGSDEPGTSACHNGRFYCRNLGHESRLLASAFVDDGVCDCCDGADEPKGKCQNTCLQAAAVRKEELRGKIQLHEHMLNRKKEYTTKASTFKEELKLKAETIDEDIARQQAEIDNLKGEVTRLEAEEAARQAEIAAANQAAEEARKAEAEAQAEQAASLQGEEAASSMDFKADEGEHAEGQAQQEEREETPEERGRRIASQWTNDPEAAAVPESEGHLNPDDQEEDVDGHYDGTEDDGTEGHFDYPNTEAQSSDYHPDHARRPPRPDPYSPLNKARAAVMEAERKLQGLQKDKENIGTFLHRPLDLGPDDIFLALANKCFTSYQTRWTYEICMFDKAVQKEGYTNSVVVGRWYGFSDDYRTMYFTGGDECWNVGPRSMTVALSCGWDERLSDGEEPSTCAYAAKLTTPAVCTEAELHELQQQLENLEAFEKEVQEKILKDEL

SEQ ID NO: 794 - protein, 521 aa, Ostreococcus tauri
MRRPHVLALVLVLGLTVVHTARADARRRHVRRGVAPIDHHRFTETHTTFQCDDASTVISIDRVNDEYCDCVDGSDEPGTSACAGRGNDRGFYCVNAGGVATRVPASRVDDGVCDCCDGSDEDGEMGSVKCANTCGEEARARREGLMKTLREATRGERRRAKEADKARGRREEWKRERDALEEKIGEKRKRVDKLLREAEEAEAEERKIREEEEAKRRTLEEMKSNDDAPNDDAPNDDAPNAAATTNGNDEGDDENGRPTEETTAGEDAGEIIGETDEERGKRIASQWISNDDAPPESAEETGEDDGNDAPIDARVDEGDADDVVSSGRSKLRSMFDRARRLLKPSRDEALAAQASKRRDAHDAARRELDDMNDKLDELRAKVDRDYGPDDVLISLSGQCFEQKIDKYTYSACPFGEAKQDDVRLGKNVAVRVDDATGSMTLKFENGEGCWNGPSRSLALALECSDENRLASIEEPSRCEYAGVFHTPFACSPTMVSNLENELAELDRVVAAASRDASRDEL

SEQ ID NO: 795 - protein, 493 aa, Micromonas pusilla
MRTTRGALRILTAALLVAAVRCGSIDAGSRVLPRGANPADAERYAAHDGSSAFVCDGGATTIDRSRVNDDYCDCDDGADEPGTSACANGEFHCRNRGHRSISLPSSRVNDGVCDCCDGTDEHDGGARCPNTCLAAGASRRDEIRARVSSARGGVDARRKILEGAPALRRRWQDESVKLEKDVAAQREIVRDASVAKEAAEAEEKKATEAEDRLNKREASKNKGDDDASGNETAVADTAVADAVPTPTPTSTETVDEYPVIEDDAVPELQAIDDVADEREESEEERGRRIAQQWIHGDSESTGTAPSGPSSPADVPDAIRDRATRAKKAANDKRDVHAQAQRTLTELEGKHKDVTKRLSTFFGPNMELAHMVGECYKLTVEQYAYEVCPFGDAKQDTTRLGTMQPVDVKDPRTMVFNGGERCWNGPARSITVSLRCGGGGNKLADVEEPSRCEYAAKLYTPAACDPGEVDALERELAEMEEEARAAMGAPHDEL

SEQ ID NO: 796 - protein, 617 aa, Micromonas pusilla
MREEARGVSGAIARSLSRARGPAATMTSTSRSTTRAVFAARRLPLLAATAAAAAIVLLLAATPARASEGDAGGSSRPPVNLLGVHPSLLASYRASDRFSCDDGRVVLDPSKINDEYCDCADGMDEPGTSACANGRFHCRNRGGEPKDLPSSRVNDGVCDCCDGSDEVGRVGGVRCEKTCAAAGRKRRAELLERLKLAKGGVAKRRAAIAAAPAARAKWSAEVARLQNERDAKKIAADASEKLKDDADERAKALEKVEEEEKAAAAADEEEEKKRAEEAEASAAKEGAEDDTAGAAAAERSERSEQSEDLAKLSRDLDELEAMIDDIGDGAAAPAPAPEHEETDEERGERMMRQWVKDDAPEKKDDDVVEDDAARDLEDPTPYLPEDVDADAYDDVNESEPEPEPESGGLLGKASKMFKGWGARRRRSAKKTRGGNASSDADASPSAATEARAEANRLRDAWSADATALRETEDALRENEARLTRFMGEDDEYAYMVGECYEAKVDKYVYEACPFGKASQDSTSLGTMQDIDRASPRTFKFTGGEGCWNGPARSLTATARCGAENKLAEVIETSRCEYVATLVTPAACAEDEERAAREELDALEREMRAAEEGGHDEL

SEQ ID NO: 797 - protein, 562 aa, Coccomyxa subellipsoidea
MGIWHVFAALILSASSLVHCSDISFRGLDPALELYYRTKGDSFACLDGLKTIKYENINDNYCDCFDGSDEPGSSACVNGKFYCANKGYNPQHLNSSMVDDTFCDCCDGSDEQPGVCKNTCSEVGAAARAALKERAEAEAAGSKLREAYFTQASEMMTKWAAEEAQLAKSIADQKALTDKWKVKHDAVVEQERKQKEREDEAARQEAERIAKTPIDTAGQDTATAAAADGAADAAVPEEPAGDHITSMEPALTGSESAVDAADEIMKGAIKEAAEGTAQALDVPLEAVEQEADTRAMNPHEAAKQQEQQEGETAEERAKRVAAQWIRDETSDAPAEDAQEAEEASEGGAAEEEAVEEAAADEDLPQTPVQSGPPSLLGRIKTAVLSFLNATPFGPAEHISDGQAVKDKYWEHHNVLADLERQHAEVHKKLQLDFGPNKEFLPLHGKCFEADVDKYVYEICPHGSAVQKDGAARVSLGNWEGFREGHTVMAFTGGQHCWNGPQRSMVVSISCGKVEKLKHVEEPSRCEYVAHLTTPAACSEEVARQLQQQVEEAEQAVRAHDEL

SEQ ID NO: 798 - protein, 603 aa, Chlorella variabilis
MGCRAALGLLALALVPALCAGGPPIRGLDPALGPRYEPTADGKFACLDGKKSVPFEQVNDNYCDCFDGSDEPGTSACPNGHFFCANKFYLPLLLNASMVDDGVCDCCDGSDEPAGRCPNNCYEKGYKSLIALKDQMAAADKGVQARNKYVEEAGASKQKWADRKAQVDAEVEKHRKEKEAADADKSKLEEEQRKLQDRKRELEEEKKKRQPPEEPAKSEGEQQQETAAFEDEQQVGGAEGVGEEQAEPGVEEAAEDEAVEKSEEELAKERMAQWIPGAKDGDGGAVEEEAGPEEDADPVLPSYDGEDLHAADAAALEEEDAEPQQFFPDEGAADVDVGASGADGDGGDAGEPGAEEGAAGAGASAAGAGASAAGGNAGQRPTSAFGKARLLLKKVFKALAKPGNETVADDTELTGAIAAIDAEISALKTRLDPARTKANEARQKLNDLEQEQRKLQAKLDGSYGEGDAFVALVDRCFDAKVDKYTYEVCPFDKASQKEGGSATSLGSWSGFEAGETKLAFKNGATCWQGPSRSMTVSLHCGQTERLAKVEEPSRCEYSAELQTPAACTPAAAEALRREVEARQRFLEGGDEVEGDPQANRDEL

SEQ ID NO: 799 - protein, 553 aa, Cyanidioschyzon merolae
MKLGRLGTPVMRPALHVWCLLWLCALLTEFVAAGTIQRVIGADPETERRFIAQIASLGGFRCSNDSGTLLPPSFLNDDYCDCPNGADEPGTAACAGLAPLSQKFFCPGEDNDKQTLPLSWVNDGQCDCCDGSDEWLSGVQCENVCDVLRSERLRELELQLARYRQGLEKRAELVEEAARIRQAEGNQLVVTKRQRLAEAERTLAAIEQKRRFFETWLRWFDTSTEALADAGERPPAQQQDAQQQASPSGLAEMVTSEVERELAAVPSERDLTTAPQAKPLWRRWWWWSWRRHHFWERFIGASDSSAPIVELDEPVDLESTACMRLMRLQAPIWVVQRFERLWGQHLAPMERIRRSVGRFAAPLLKRSVQHRHIRTCLRLAQGGVARAHREREEAARALEEAQRLEDAYLGPQDVLLGMRDHPCLRKTVGQYDYEVCLLQHVKQYERVSRGSHTGIVLGSFAYAEHVSVNWSGSPDKLALQYLGGDMCWNGPQREATVIVECDPNLSILTVTETERCKYRVTLQGPLGCFEEALAELERQRARLSVQQQPASSS

SEQ ID NO: 800 - protein, 490 aa, Galdieria sulphuraria
MGLIKMRPVPVFLIWILLLVTQETCGISKVRGADPQKLHLYENKEGFFHCLNSSQKVPYSSLNDDFCDCDDGTDEPGTAACDGSTFYCENIGYVPVNILSSQVNDGICDCCDGSDEWLGYVDCPNRCVQNGKERIEQMLAEVKIIKQGLKKREELKSLSSLRFSELVNKTKLLQVSIHEAEVLERKAKKELHWLEHVLRVIEARDIVANASVGNLSSHSSGDVVTTNEESSNDLGRTHSLQNEDDELNVNSEKTSDEVYKSTMRSDFVLETCQNISKVYTSSHMLLRLQKLFFDFLSKFPVLSNFFKGSQRKIDTEVLKLCISNLKEHLETLRSELEKNRTELERVQQYFSSDYGPENVFLALRDICLEVDSQGYHYKLCLLSHVTQDSINLGKFSQWDSNYTKMIFSDGTPCWNGPARSTVVNLLCGVNETILKVSEPSKCQYHFWMTTCAVCSVHEMKKLRDEANIILSNLNLTKGQKSNMAHKHDEL

SEQ ID NO: 801 - protein, 999 aa, Thalassiosira pseudonana
MYSLASALYAISLALSILQQNQHKMFASASVSWSLECASNAWFDGAPKTLHTIFADRINDGYCDCPLDGLDEPETGACSGSMDGMWAGVPAIVKNAAVANSFVCPQQPSLRLPLSRVNDGICDCCDGADEHLSPLAPSASSSEPSTSACPDICDAVLAAERAAKAKAEEDYKVGSQKRLESIAQYQKWNESTRRNLQQLKDVELAKVNNDVSEVEQELMLSKIALAKEWLRVVKEDVLNSVPLMGIVGKTSQSSSNNHMSLDDLASFIISLCWVSGEASSANVASGRCLPLDRASMDVGILWDHTTEESLPTFHYLDSDNEASLLDFGEKILLRLEGNDSATEKPLKKNNKQYEKDESEPDYGDDDYFGDDYEDYRDEGDVESSDSAEVASSETDEIQQKEPNPDDSMVGSRLKRLHLASTRQLFKEQAKLLLEYASTVHNESEEEENGHEESSSLDERETLEGGEETKSPHSSGIDPMAVKMVTSTIGKRLSNISRGEASAKSAAPYIVSLMKNRSGGGSVLDDLQSLAIMAMYHSNVRTKDLAEIVYTTSSEFHSATKTQDETSCSAVSPWSNMCPPRVVSLQGDAKHTFPPPFVFEAARQRCEKREDALVADEKEFPTSMPEGYYNYYTPQPRGSADELSSLFSNVDTLHKMPTDIVELRERKGKLDNSKKSLLSTISKLESETGSGGNSPKFGVDGELYIIRDTCHTVESGKYEYEVCIFGKATQRDAGQKSGGTNLGSWDKVERYDGGRRLKWSGGTKCWNGPARSAEVVVTCGSETKLLTADEPETCRPPPPPTHTHKHHKPFPSEMKVNVHFLELATVGSEQNLNVLWHLVDIQSPPQLSQSALPQGWAILEGDLVVFPSLASGAGEMEMVRFVGPKTSHVSEKGDEDALPLLAAGVEYPQFPQLIVSLAEERGVSLREMYEAPLDLVLRTQPPNLGLRDLYSNDDEAYEGFWQNPPVARRRGPSGDPWRISLKDCVWKQTVELPTAKGDEL

SEQ ID NO: 802 - protein, 797 aa, Thalassiosira oceanica
MARRKVIAFALSTSLLLLQNASSSGLVCKTWTGADQEVPPPRVNDGYCDCPHDGSDEVGTGACAGSMDGMWAGLSPRLLPSDADAAVPPAAFACRQQPSLRLPLSRLNDGICDCCDGSDEATDPSLSSVSMRGSCPDICDEVLADERARVAKLRSDFEAGFKVRAEAIEEYDQWRSRSEENLHQLRDVDMEIMKKDKEELDLRLTTAKLTFARDWISSVMDITSLMSTNEHQPSLKGMLIMDEMETVSFILSLCMLSAEISAQNLVNGRCLALDLASLDLGIIWDHSSDPMPTFTLLDSESKDSLSQYADSILSRIEGKEAKKGPQSNSRRGGRHGRNDRPPPPDVSSGDDPYGDDWEDNDHDDDEDIESPHQDGELESSDGDSGVESPKSSIENIVEELMDSLPHDRSLFRKQTSLVLNYSPPLSGKKQTKTEEIDDIVPEDSPEGAAESEEEEQENEHEVDPMALKEVKLALGRLSGSVDRGEISAKSAARYIVAMHASETVLDVELLALMVLYHSKISASDVAELIYMISSEFKVKEDEATCSAPWAAMCPPRTKAGEGGRTYPPTVIVEAAQAVCDQREGAAYVCSSQIEEELNLPTEVSDGYYNYYEPRGRDVDDGLSAYFQDLDGMQMIPADLSDLMKQRDSVEKELKSLSIRISSLERELGDDSDKSKYGADGELYTMRDSCHKVEQGKYEYEVCIFGKATQRDIGQRSGGTNLGQWHSATVDENSGKRLLKWTGGTKCWNGPVRSAEVSITCGAKTKLLSADEPETCRYILEMESPVGCDESFKQSNAL

SEQ ID NO: 803 - protein, 1006 aa, Fragilariopsis cylindrus
MIYRFTQHNDAQIENKATSVVDFNLVNNPSAAASSLSSTTENAIPHYIPTSWINDGYCDCPFGNENGMTDEPNTNACSGSKSWPGVKGSIISTSSLPEETNTITTTDVYYVCPEQSKLTLPLSRIQDGICDCCDGSDEDQFTICPNNCDELLKEERELEAKIKHAYIVGSRQRDSDIQTFQTVRTQKLLNIENNFKPQIIELELDISNILNLINDSKQKYVQSRINTMKDSVVSHQLSTELLSGLLMSSTSTSTTNLLENFIIHLCQISGELMMNDDNEFSNKIPNDDLHRNSCSPLRVAALDIGLTWNNAIDTAAAAAAAAITDDNDDNNDNEDKVAVLFSIPSLRWTNTKTKRKKPQPRKGGRRLAFEDEDSNYDDDFMMDEEYERDNMMMDDDDDLYNDQDRDDYDYDDSSSSSRGWKDNEDDDNNDEDIDNDATTTTDVDVDVDVDDEMTSKEDEFINDLLKNQLKLFSKITQRINYLQESEQMIQKINQILDSPPPPLPPPPPPTIDVDIDEEKKKENDNDNNNNIEEEEEEGTTREGEDEKNTVITENDGNAADVVLDEETTAVADDEINTAATTTENDDNENENSNKFDPTSYTMVRQKLRQKQQIIQKGLRWGASAKLLFDDSKNISFSNEDLKRLAIGTLFYGQISSLQVWQIIISILESTSNNNNSSVDDDDDNVDNHDRMLNTCSSPWSEYCPPNQTVFKYGKDNDNDDEELELESILYPPSFLMDVAKVFCEEEGLKFAAGGSSTSAASCGNNTNNHNNDDVGDENDNEKEDIAIFVSKYNNNDDDDMKEDEESFLYNFGYTVPVRRNPDGSDPLQSIFKSIIELPIDVDGLHQLEKSKKSKEDEIKDINRSINDTWKEIGGIDGNELGRDGEIWKIADKCFDITAGKYTYEVCLFGKALQKESSDKGGGTNLGQWTGIEYENDDNGDASIRVMKWENGAKCWNGPKRSATVYMKCGIEHRIISANEPDTCRYVFEMESYLACDDSYKLRAGLL

SEQ ID NO: 804 - protein, 697 aa, Aureococcus anophagereffens
MWRWRIAALLAALLRAVADDAAPACAVPPDRVDDDYCDCPVDGGDEPHTSACASAALAARPSFACAGGGAGSAAFLPASRVGDGVCDCCDGADEPAGFCGDDCAALRARAEADAAAARAAAAAGVAKMRTMACEARAGKAEAARVLAGSEGELDGLRAKIDAARARVDEAREAHAALKRADGERAIYKELRLDALSGSELRRLVVDLAREAKAGDALVRLARVANGLPAVEPAEAEAEPAADEPATEAEALEAEAADEAAEPEPEGAEAAGAEAEAVGAEPESEAAPEPDADAVEAEGVEAEGAEAEGAEAEAVEAEAESEAAPEPDADAVEAEGVEAEGAEAEGAEAEAVEAEAESEAAPEPGTEAVEADAAADSEAEPERPDADADADADAALDEPAPEYEQTVELDGGGEDYDAYGDDYDFRDDYGDGDYGSNSFAGLDDEDFPDDEYGDIPDDVFPDDDYKSRRYDDDDFDYGKSYEPADPRLDVDGHADPDKGYVSAAQKKALKKLEGALRDLEEEQRRKERRLDKARDALGDDDRYGRDSALWPLRETCISKKFSGYKYEVCFFKGAKQGSTRLGDYQRSTKHANNVTATLVYEHGEHCWNGPSRSLAVTLVCGAETGILDVDEPSTCVYAATVETPAVCVDADAPDVDCAGYKPAFALFDGLDSPKKRKKGARKLLKKAKAALASFFGRD

SEQ ID NO: 805 - protein, 525 aa, Nannochloropsis gaditana
MMILWTLPVYTLVAVIAISAEASPVDILGIPRSADPLYAAAKAKGKFTCQSDKKIVIPFVQVNDNYCDCPDGSDEPGTSACAPQGRFYCVNEGHVGASIPSSKVNDGICELACCDGSDEAPGLCPNTCREIAAQKAKERAAWRQVVEEGMAKKKQYMRDASAMMEARYKELASLQAQKVGLEKKVADARIEKESEEGKENVKRDEAMEQAATTLISGLKIESLGQEELVSLHRKLKGRPGKALRRVLEEIRGKAGIEEVEGEEEGEGGEQRPLSDIAAKEEMEKKMKEVKEGTFHDQLGPVPAEDEDEDAEGDEDDDEEIEDDDYSPPDAAQEPLDPALVSLLEAAEEGLDEPSAGAEAARQALKDARDEERTVRERIQEMEAESQDDYGDGYAFYLLRGKCFSKTVNKYRYEMCPYKEAQQVEGSAARGTSLGKWGGMEQSNGTVAGGSSFKFLFRKGQQCWNGPERSLTVTVECGVEDQVVSVEEPSMCEYAMTFKTPAACSPALLEWDDQEAAGREAFHSEL

SEQ ID NO: 806 - protein, 527 aa, Emiliania huxleyi
MTIAALATVSAAFECDGRALPGAYLNDDYCDCADGSDEAATGACADTIYVCRNLPHKPKQIFSSRVNDGVCDCCDGSDEANSTDCPNGCIALATEAFGALSRGCLRRAELAIAAAKAASSDAERLSAARAQLATATPTIDALHDAKAAAEADEASKRDGRAARLAAGEVETSLGVERLDAGMTLRALVRVALWGGVEGVDRMYDLLVERPGLEEAAEEVAMKARDEAAAEKGQSAGGGGGGGVCDAAGACGHAREHEAALLQLLEPLPEDGGALRAVLRVLHAELGAGATSALAQAARELLAETESPLDDAAVAAALELLEPFRHDEAEAARAAHKAAVEAVQEASEAERQLAPKEAIAASGGYGAGLEWRQLHGRCFEAEDRGFTYKACPFQEMRQGSPGGRASRQQTLLGNFTRWEPVSGERASQLARAGRTPSELGTMRFEGGAACGGGAVRRATLYFECGEQDALLEVTEPETCVYEAWMSTPLACSLALLREKVATLEEASAAASLEFRPSDELRALLAAPE

SEQ ID NO: 807 - protein, 499 aa, Guillardia theta
MAGAGRALAMVSMLALVAMSVQSEEMRGVQPEDAHLYAKKDMFTCKDGSSTISIDKVNDEFCDCNDGSDEPGTAACSNGVFWCANKGWKAKLLFSSRVNDGVCDCCDGSDEHAGIVTCVNRCQEEGAEQRNILMRSIQLHEQGVAKRSDYVARAHAFREAVFKRRDELGNLIQEVSQKLDGFQAQRDELNKKISEETEERLRQEQEAREAEEKKRAEEEQKRAEELAAQQAEMANQVPSGEEIKSSGDEFGSPEVPPMAPQAVDDLGETQQVVQEGKGYEDPYYSGKHVDKRPSPTGNPDPNTHVDDWYSYDNDHTDEEKPSEDEYRPPEEEYKPPEERPKTEAESESELAVKVLEYDFGPDMAFMALYDKCYEQQVQQYTYEICMFRHAKQKDGGSEQNLGTWSHWTHENGHNSVMHYTNGGGCWNGPARSMKEQQALPPARSADILEQVSMICGEDEFLVSVQEPSRCVYEMEFMTPLACSAHRAQEAREQLLAISH

SEQ ID NO: 808 - protein, 815 aa, Trichoderma reesei
MAKFAQLLASAAALAVGASATGSETVLISEVGRLNNQSLLWGPYKPNLYFGVRPRLPQGLWTGLMWGRAEQYMDIQSLFRYTCEQGQDIHGYGWDEYDARTGGVQTIHDEGNGIDITTSFIKVPGGNHGGSWAARIKGTVRDDAPADTKFLVHYYIAQEGLGDLEVEGADEDNGLGFEGDVRLKGSSNSLGDYSIVVTKGSGNHPTSDHEISASRRGDTTVVRSLGLPEEHLWQAKPATFRELQESIQEIQQSYTDETLPPPWQMFRLTSKPGGGNAHVIQKTFEGSFEFDVIFSSASAGRELTSHDVTREIKETSEAFGERFSSVFDLKAPYTDDKYRKFGESMFSNLIGGIGYFHGHQLIDRSYADEYEEENEGFWEDTAAARARHAEQLEGPYELFTSVPSRPFFPRGFFWDEGFHLIPIADWDIDLTLEVVKSWYNTMDSDGWIPREQILGPEARSKVPKEFQVQYPHYANPPTLFLIIEGFMERLRSANVSAPAGKETLLQGQDLYSAHLDNLELGSDFLRKIYPLLRRQYDWFRKTQKGNIKAYDREAFSSKEAYRWRGRTETHCLTSGLDDYPRPQPPHPGELHVDLMSWVGFMTKSLINIADALNLADEISELKKNLFAIERNLDDLHWSEKEGCYCDATIDEYEEHALVCHKGYISLFPFLVGLMQPDDAKLGKILDLVGDESHLFSPHGLRSLSKQDPLYGTEENYWRSPVWMPINYMALTQLHRIATQEGPFQSKARGLYNKLRTNLVDTVFKSWEETGFAWEQYNPETGAGQRTQHFTGWTSLVVKIMAMAPLDETVPVRDEL

SEQ ID NO: 809 - protein, 814 aa, Trichoderma virens
MAKIAQLLASAAALAAGAAATGSETVLINEIGRLNNQSLLWGPYKPNLYFGVRPRLPQGLWTGLMWGKADEYMDIQSLFRYTCEQGQDIHGYGWDEYDARTGGVQTIHDEGNGIDITTSFIKVPGGNHGGSWAARIKGTVRDDAPDDTKYLVHYYIAQEGLGDLAVQGEDNDGLGFEGDVTLKGNSNALGDYTVVITQGSGNHPTSDHELSASRRGDTTVVRSLSLPNEHIWQAKPAVFQQLQESIQEIQKDYTDETLPPPWQMYRLKSNAGGGNVHLIQKAFEGSFEFDVIFSSASAGKELTSQDVTREIKETSEAFGQRFSSVFDLKAPYNADKYKEFGKSMFSNLIGGIGYFHGHQLIDRSYADEYEEENEGFWDDTAEARARKAQQLEGPYELFTSVPSRPFFPRGFFWDEGFHLIPIADWDIDLTLEVVKSWYNTMDSDGWIPREQILGPEARSKVPAEFQVQYPHYANPPTLFLIIEGFMERLRGANVSAPAEKESLSQRQTLYNAHLDNLELGGDFLNKIYPLLRRQYDWFRKTQRGSIKAYDREAFSSKEAYRWKGRSETHCLTSGLDDYPRPQPPHPGELHVDLMSWVGFMTKSLINIADALGMADEIAELKKNLFAIERNLDDLHWSEKDGCYCDATIDEYEEHALVCHKGYISLFPFLVGLMQPDDAKLGKILDLVGDESHLFSPHGLRSLSKQDPLYGTEENYWRSPVWMPINYMALTQLHKIATQEGPFQGKARGLYNKLRTNLVDTVFKSWEKTGFAWEQYNPETGAGQRTQHFTGWTSLVVKIMAMASLDEAAPIRDEL

SEQ ID NO: 810 - protein, 893 aa, Trichoderma harzianum
MAKFAQLLASAAALAVGASATGSETVLINEIGRLNNQSLLWGPYKPNLYFGVRPRMPQGLWTGLMWGRAETYMDIQQLFRYTCEQGQDIHGYGWDEYDARTGGVQTIHDEGNGIDITTSFIKVPGGNHGGSWAARIKGTVRDDTPDDTKYIVHYYIAQEGLGDLAVQGEDGDGLGFEGDVTFKGSSAALGDYTVVITEGSGNHPESDHEISSSRRGDRTVVRSLVLPGEHIWQAKPAVFQQLQESIQEVQQQYTDETLPPPWQIYRLKPQVGGGNVHLIQKVFEGSFEFDVIFSSASAGKQLTSQDVTREIKETSEAFAQRFSSVFDLKKPYNTDKYQKFGKSMFSNLIGGIGYFQGHQLIDRSYADEYEEENEGFWDDTAEARARKAQQLEGPYELFTSVPSRPFFPRGFFWDEGFHLIPIADWDIDLTLEVVKSWYNTMDSDGWIPREQILGPEARSKVPAEFQVQYPHYANPPTLFLIIEGFMERLRGANGSAPAEKETLSQGQTLYNAHLDNLELGGDFLRKIYPLLRRQYDWFRKTQKGNIKAYDREAFSSKEAYRWKGRSETHCLTSGLDDYPRPQPPHPGELHVDLMSWVGFMTKSLINIADALGIADEIAELKKNLFAIERNLDDLHWSEKDGCYCDATIDEYEEHALVCHKGYISLFPFLVGLMKPDDAKLGKILDLVGDESHLFSPHGLRSLSKQDPLYGTEENYWRSPVWMPINYMALTQLHRIATQEGPFQGKARGLYNKLRTNLVDTVFKSWEDTGFAWEQYNPETGAGQRTQHFTGWTSLVVKIMAMAPLDEAAPIRDELPDDSPDDSPDFAKIEYCSRRDWFRCMDATLVGLGWAESEADVIGMALLGLRGTCDAQAAIFQPPRKAHAYSSAALTRIP

SEQ ID NO: 811 - protein, 814 aa, Trichoderma atroviride
MARFAQLLASAAALVAGASAIGDESILINEIGRLNNQSLLWGPYKPNLYFGVRPRLPQGLWTGLMWGRAEGYTDIQQLFRYTCEQGQDIHGYGWDEFDARTGGVQTIHDEGNGLDVTISFIKVPGGSHGGSWGARIKATVRDDAPPDSNYLVHYYVAQEELGDLIVQGDDNGGLGFEGDVTFKGSSHSLGDYNVVITKGTGNHPTSDHEISATRRGDTTVVRSVSLAANDVWQAKPAVFQFMQDTIKDMQQDYDEENFPPPWQIYRIKSQAGGGNAHVVQKVFEGGFEFDIIFSSASAGKEMTSKDITREIKVASESFGERFSSVFDLKAPYTAEKYQKFGKSMFSNLIGGIGYFHGHQLIDRSYADEYEEENEGFWEDTAEARARKAQQLEGPYELFTSVPSRPFFPRGFFWDEGFHLIPIADWDIDLTLEIVKSWYNTMDSDGWIPREQILGPEARSKVPPEFQVQYPHYANPPTLFLIIEDFMERLRSANGSAPAEKEKLSQGHTLYSAHLDNLELGGDFLQKIYPLLRRQYDWFRKTQRGQIKAYDRESFSSKEAYRWRGRTETHCLTSGLDDYPRPQPPHPGELHVDLMSWVGFMTKSLISIADALNLADEIEELKKNLFAIERNLDDLHWSEKEGCYCDASIDEFEEHALVCHKGYISLFPFLVGLMQPDDAKLGKILDLVGDEDHLFSPHGLRSLSKQDALYGTEENYWRSPVWMPINYMALTQLYKIGTQEGPFQRQARGLYNKLRTNLVDTVYKSWEETGFAWEQYNPETGAGQRTQHFTGWTSLVVKIMAMEPLDEAVHIRDEL

SEQ ID NO: 812 - protein, 822 aa, Aspergillus brasiliensis
MHLSKISAFLTPVLNAAAVLSSQAPADDLSVLSSEVARANNQSLLWGPYKPNLYFGVRPRIPNSLFAGLMWAKVDNYATAQQNFRHTCEQNEGMAGYGWDEYDIRKGGRQTIHDAGNSLDLTIDFVKVPGGQHGGSWAARVKGVPREDADPDQPTAVVFYAGLEGLGNLGVEGEPEDTHGFAGDVKLGGFTTDLGDFSIDVTSGPESNESPEHGHPTYDEKPLDRTLVSSLTMHPEQLWQTKVIMFTQMKKEVDEMVEKYGSENPPPPYQLFTIKNEPGDGNMHLVQKVFKGSFEFDILFSSKSSPQPMTSELLTEQISSASLEFAERFESVHPPQAPFDTAEYTEFSKSMLSNLVGGIGYFHGTDIVDRSAAPEYDEENEGFWEETAEARGRAQPILEGPKDLFTCVPSRPFFPRGFLWDEGFHLIPVIDWDTDLALEIVRSWLNLMDEDGWIAREQILGSEARSKVPPEFTIQYPHYANPPTLFIILEAFIDKLDAKKNASMQTYADSGATDGLRSIFVDQPELGEAFIRSIYPLIPKHYYWYRSTQKGDIKSYDREAYSTREAYRWRGRSVQHILTSGLDDYPRPQPPHPGELHVDLMSWMGMMTRALRRIAVTIGETEDAEVFKTYETAIERNIDDLHWDDDASTYCDATIDEYEEHVHVCHKGYISIFPFLTGMLGPDSPRLKAILDLIGDPEELWSDYGIRSLSKKDQFYGTAENYWRSPIWVNINYLVLKNLYNIAIVSGPHREQARELYSNLRKNLVENVFQEWKKTGFAWEQYNPETGIGRRTQHFTGWTSMVVKMMSMPDLPASEQKGHDEL

SEQ ID NO: 813 - protein, 902 aa, Chlamydomonas reinhardtii
MAQAKKGDKQKGLGGVPITYIAGALLAAAAAAFFALRGRAHFTKGPILTPLKAPKVTDLLEFDAAYKDRMLWGSYRSGLYFGMRTRTPKGLVSGLMWFDPDDFQTLQQYRVRHEASQGDGLASYGWKRHDGRTYGQQVLVDNDYNITLSMLKSFGEGSGPGGDWSVRLQLRRTSGMPTQRRRISVVIYMGDEDTPREPWQVLPDGEVTDLRPQPAALLTGGSAALGRGGARWALHAMEQATEPPASRRSRGCRVDYLGMSTEGHKPDYLLKVRELLLSTMYERLQRQPPSDKFRLYLPNGATTNSDLALFQVTCVIPSTVDFAFTSSSGDVSDSSERLEGLLGPGLDGPLAAAEAAFDQRFDRVFGEGIARALQPQQQPDSAASPDASTPDAPDAAAVVETAKAALSNLLGSMGYFYGSSLVRTGPPGSEPAPYWPAPLFTAVPSRSFFPRGFLWDEGFHQLLLQRWEPALSRDVIAHWLDLMNAQGWIPREQILGEEARARVPPEFVVQLPWHANPPSLFLPIAHMAAQLGRAQQQATDGTAAASDAESAAELERVRAFLRRAWPRLAAWYNWFNTTQAGPLPSSFRWHGRDPLAASELNPKTLTSGLDDYPRASHPDDSERHLDLRCWMALAAQAMADIGTSLGLPAAAVARYAAAAEQLSDLRQLAALHLDQGRGVFADWGTHTEEVALEVKSIVVPGGEGQPPQRRDVSERVTTGWPQPQFVPQFGYVSLFPLIMRLLPTGREPNATASAAATAATAGATAAAGGAALTLQQLQLLTDPSLLWSEHGLRSLAKTASLYKKRNTADDPPYWRGQIWINVNYLVLRSLSYYARHGSPEVAAAAAAAHDELRRRLLRTLVGGYKRQGYLYEQYDDESGRGTSSHPFTGWTALVTLIAAQEY

SEQ ID NO: 814 - protein, 933 aa, Volvox carteri
MAPGKGVKSKGKGGFSVQILLTAILPQVLSPLKAPKLTELREFDASYKDRLLWGSYRSGLYFGMRTRTPKALLSGLLWFDPDDPNTLNQMRARHEASQGDGLTTYGWKRHDGRLYGTQELIDGEYNITLSMLKSFSPESGPGGDWSVRLQLARTAGTPPRRRRISIVMVRTAGVACASPFGGSCSSPSHFPHSPCLPQVLPDGEVADLRSGPATLLTGASSALGRSGARLALHAMETTDGEERPRQLAPWGGRRISVCDRLACLPFHNMLASPPAAAAVSNSRSRGCRLDYLSLGMEHKNYLLRIKELMLSTMYERLERWACRGGPGDARRRRRSWRSVSGGFGGQGGVSEGGTEVVGRVQPSSNRFRLYLPNGATTSADLALFQVTCVLPSAVDFAFTSSAGGDRLGPLLGSGLSEALAAKQAEFDQRRRVFGSGLRAPLSGGRTVTSEGGEGSLPDGALEVSRAALSNLLGSVGYFYGSSLVGGWVVLAIAKRRMGGWVRTDPPGSEPRQYWPAPLFTAVPSRSFFPRGFLWDEGFHQLLVQRWDPQLCRDMIAHWLDLMNAHGWIPREQILGEEARTRVPAEFVVQNPNHANPPSLFLPIAKMASQLEEQEEEEELQRVSAFLRRAWPRLEAWYRWFNVTQAGPLPTSYRWHGRDPLAAGELNPKTLTSGLDDYPRASHPDDSERHLDLRCWMALASQRYRAAAASLSDRGELQRLHFDSTLGRFADWGMHTEDVHLGRRVRERILSQSVSQRVTSTPPTPQFVPQFGYVSLFPLIMKLLPTGTSTSADDNDPAAAELTLQQLQLLQDPALLWSPHGLRSLATTASLYKKRNTADDPPYWRGQIWVNMNYLVLRSLSYYAKTAGSGSEVGRVAAAAHDELRLRLLKTLVENYKRNGYLYEQYDDETGRGISSHPFTGWTALVTLIMAQDY

SEQ ID NO: 815 - protein, 738 aa, Coccomyxa subellipsoidea
MWFDPDQPQPLEKIRHLAQERDGLQKYGWEAHDGESFGRQELYDGNVHLTTSFAKKFCEAGISTLNVLPDGLPSGADMQLAAGESEVVGSWALHMHDVSGKGRNTAKLRHLGAQTAHFHNLTTTLVDELAESVTVEVPAKRRGGSNGKRERHQLSDTVDAVPNLAVFQVTAELPLSLDFVFTGSLPPSSQGVSQMLGTAASGLWRSLGSLRRSLPYCITDLPVSIAKEPLLQRVAALSGSRLTQLLREREDAFDARFRKTFGSFTSGAPAGTDVVSKAALSNTLGGIGYFFGSSEVKLPDQGNKIVRSWPAALFTAVPSRSFFPRGFIWDEGFHQLLIRRWNERLSRDILGHWLDLLSEEGWIAREQILGEEARARVPADFIVQSPDVANPPTLFLSLADMARRIAQSGVNWDNAGSREDLEFLTAAYPRMEAWFKWFQRTQAGQLPGTFRWRGRGTAPEWDTELNRKTFASGLDDYPRSSHPSDAERHVDLYCWMTLASRALASIGSTIGVTADKVAPIRKVHTQLSDVAFLDRMHLDLGAQQYRDWGNHTEAWAEMRTPEGYVVRRTYVRMVGQPGPLPQFVPHFGYVGLFPLLLRMLPGDSRQLGAMLAQLRDESQLWTAAGLRSLSKASSLYNKYNTEHDAPYWRAPIWLNVNYLALAALKHYSRVPGESRELAGRIHDELRENILRNLVEQYNKTGYLWENYRDENGRGQGSHPFTGWTALVVLIAGETYFDI

SEQ ID NO: 816 - protein, 809 aa, Chlorella variabilis
KPAVLQPFPSRQLKQLPQFEGQHAEQLLWGTYRPGYYFGMRMRRPQSLLMGLMWVDPQRQDPLGNIRHEAQQRDGLAKYGWLQHDGQGYGLQQLWDEQFNITTAWAKHLCPDCGLGGDWGASVSIEERHIGASDQPRRRLLEDEYAEPDGDEGGEQLEEQQQRPQVASLRPVISGRTAPVGNWQLHLQRGTSPSGATPGAILAVNYLAVATPHMHNLTNLVREGVMASVRQQHAAGQQQYRLVLPDTTQPGSNLAIFQVTAVLPLAIDLSFVSGLKAGSTGQHLAGRVAAVSGSGLKQRLAAGAAAFEQRFAGTFGSLAGGSAAARALAQLPGGAGAVARAALSNMLGGIGYFFGHSLVRVRQRRQGQVVETTAKLWDTGVYTAVPSRSFFPRGFLWDEGFHQLLIRQAAQWDAAISRDILGHWFDLMNTQGWIAREQILGEEARARVPAEFVRQSPDAANPPTFFLLLSDMSQRVAAAAKWDDADRADAELLKAAWPRLRAWYLWFNSTQAGPVPGSYRWRGRDANNQQELNPKTLTSGLDDAPRASHPSGKDSLRPARHVDLRCWMALATRALATIGSNLGLPHKQVQPFLESAAWLEDFERLNALHLDEASGEYRDWGSHTEDVELRRPMATLSDGRQVPTGDMQRVVIGQPPRLQLVPQFGYISLFPLLMRLIPPDSPALGRQLVLLREPERLWTDYGLRSLSRSASIYQQRNTEHDPPYWRGAIWININYLAALQHYGDTVGPYQSQAAGLHQELRRNLLQNIVREYERTGYLWEQYDDATGQGKGSHPFTGWTALVALLAANH

SEQ ID NO: 817 - protein, 960 aa, Cyanidioschyzon merolae
MRKRLLSRRQSRCCARRYAAYLVALALVLVFGAFQQIETAVARATAHRNGTSLRTSSEREPVQTKPTLDPHTMSSLVPGVFAGYRRPVPHSPVLGIMWYPADEPFESVRLRLECGTELDAAGPLRYGWLQHNGRNYGVRHIEERGWHLNITHVAHTENLNLLQPDAQLSSEQQPLRSPEFSVRIQGTGQERRTVSFIVYWTAQHDEIDPERLQESAARGMEPPTLQHCSSPSITVASSNEVHLECGPDHDHRWRIVAVQGLPERSQWRQRRHRRRRQRASASRPVSAEILRELPDPGRIYYRKGRVNVGATTEVKSMVESWLRESYDHQRTRLREFYEKHEQLPDTAFRGADVFKDAAHARETPTAAPFPIITRIEDVDARARREVNADAELEPDAQHHSGIDDGLPSNLLVVQITVQTPFDIMITSSARMDASALSVLLEQADSRFRERFQQLFPRMHRGDFGSAQIAQARAALAGLLGGVSYFYGSFIAGENTQDRGSDQLRVSPPRALVSAVPSENKFPRGFLWDEGFHQLLIQRWDPELSLICLDSWLGFMQPSGWIPRELALGIEARNRFPRELASLLVQSEKVANPPTLMLPLYRHWQLLQDTFPVLELETFSSLCSQGGDGSLSDYAAMVLNQSVGDCKAVAQTTNTARLVSHLGFRKMKQYIRWLNATQKNHGWFGRHLTTLLAQDGGYPLTLASGFDDFPRSTDPSPYDAHVDLLSWILDGVRRLLVWRRTAGDLAEASAVSPPELGALEAVLQQRLYEVHWNADAGMFCDAGPRGNSSTSIVDTWRHHCHLGYPTLLPLSLGLLPVNATSTGALLKAVADPRQMYSDFGLRSLSAADPFYMRGDRYWTGPIWVPMNYLILAALREKYARMPGPYQKLAQQLYERTRNAMIQTILREHQRTGFFWEHYDPETGKGGGGHAFTGWTSLLVLLMEEDFRGVIVIDETGTVLKS

SEQ ID NO: 818 - protein, 865 aa, Galdieria sulphuraria
MGGVDCNKFDFLCVVLFVICISIESHVVLGSDILYLLSGNASQVDLWGTFRPQTYFGMRAKVPNSLQFGFTWFVASKENDYERLRNYVSSGDDGVTRFSWLAHDGRNYGHEIVEEERNGVRIHFEWIKESDVGIGIRIKGESLSAGSNNVETQMISILPYLFVARDESFVERLSELNEQGKHRKSASNEDSLGFIQQLDDISFQSRDTQTDIHWTGNTKANGPFYASLRQPKSGLLHLTRASRRTKLRKGFGSILSQDLSHSYSVSLSLPLTESWKYEAAIKTILDEVKAVQEKEDNQPEIYDEEVEEAFQTRTGTIPILKEHRDDKATLSIAQRILSVPFELEFVFIPTMTQIDFGSEWLTSRITALTGDKLTEKFMHKKMAFERNFQETYQLDKKGYSLESIQIAQYALANVLGGIGFFHGSTLLSEPLQNSQRAKDDINNLILPNVSLLTATPSRHSFARGFLWDEGFHQLLIASWDPLLSFECLSYWFSSCASTGWIPREQALGDEIRNLFPSHVKQFIMQDPNIANPPTLLLPLRRLAKELQRVNSNKFTQENAYSQFSLVSSRVSCGHFLWKVLSQRLQQILSWFENTQISYSSNGDWNGYRWIGRHTSKVASNGNMPLTFASGLDDYPRALVPNERERHLDLHCWMSWAWNASTDILPCAGEETISASKRAERLVSLLEPLHRPSKNMGDIGSVGNLLCDFDGQGQSVCHEGYVTLYPLALALLPVDSPYVGSILKLIDDDNKLHSGYGLRSLSKNDPFYQRGDGYWTGPIWVPINYLVLASLHEKYMKEGPYMEIAKQLYSTIREQLVSNIVMEYQRTGFFWEQYSDVDGHGQRTRGFSGWSSLILLIMAEDYSGVV

SEQ ID NO: 819 - protein, 966 aa, Nannochloropsis gaditana
MRQMFWLFRILGLSLLLLHVIRAFNAPILGTLINPGIDACATDPEGWIKGPVISDAQEDAVSKVLTAQHNVTFLWGTYQPGQYFGVKSRTTPATVAVGLLWHGPEHGIADARSECRQEDRIKKYGWTQHDGRHYGRQVINDAAQNVNLVTEYVRLRSEEEGYWGARILVHPDRQATDGVVDREVATKGKKAQSKKSEGLSGKDQRAVFLYVAIDCDGAVSASNCLENGAEGLDILIDRRKRSGAAFIRGKTSDLGDFTLEVGVTSLTATVDIQRDISGSGADGAKDTSPDSPPALSITYWGGANVLLADLKARLVGEARPAPLKGNRQAQHNRGKSSVLPDEIPANSNVVVLRVASSGSFQIDARLRPRTPQEREKGGDDDDDEPGSEDVAEIESLLDRTTRRGLEEFKERFASVFPLSQHGYRGRNFTSEEIEAAEAAFSNLIGGVGFFHGRTPIRGQFEWEEGGSGGTRVLDSFPTSLFSAVPSRSFFPRGFLWDEGFHQLILHKWDSELTYDVFLHWLSNMHAHEKCQDLGWIPREIALGEQARRRIPAEFLPQDVAVANPPSFLLTLEDMLTLSGASADQCEVKDEDGRRSQISSMSRQSDFLEAIQDRLERWLLWLLSSQRGENLGSFRWRGRGDPKEKLMATTFASGLDDFPRASEPGPEERHVDLLCWIIKGCQILSQLAFERAAHSLGEAEKVQQKRGKKYATVAEELLGALDDLHWNETLGGYFDYGMHSEDGYIGETYPVRCGNPTSKTVTNVRVERSILMQWDDEGGEGETKICPPDFPTPLGMLSQEATLEYFRGPEIAAQHVPRRGYVTLFPLLLGLLPADSHRIRPLLDSLKDPAQLWSPYGIRSLSASDPFYHKENAPGDAPYWRGYVWINANYLILRSLWHLTRTVGPYQSEAKELYTRLRDALLRTILGQYQTTGYFWEQYSDVDGQGMRCHPFTGWTALVLNIMAEDF

SEQ ID NO: 820 - protein, 748 aa, Emiliania huxley
MPPKHASRPPASRQAQRWAKDLKLIGAAAALVAAFLLGSAFLSPRSHRVSSSAPKRPQSASPPTAPVPIALAGGTLSRFTAEHNASLLWGTYRPGVYFGMRSRTAPTALVAGLMWTRARPDGGVDATTLRHQCEQDGLERYGFTAHDGRGFGSQPIVDRANGVHLTTTFPIAGAAPKQHLFLYLSLDTEFAPRLSRGAALGKLEVLSFQPEEGVHVGGQVEEVGRFSLLAAARTQGGDPLPLRAWGSAARHHSHLNVAELIRSRTDAFHARLASTFGLDEQREGGALRLGGSPLGEREKGFAAAALAAQLGSLGFFYGKTVVAPPPGSFSPPPPPQETEAAPLFAVVPSRPFFPRGFLWDDGFHSLVVGEWDGPLADDIAAHWLGLMHEDGWIPREQILGAEAAARVPAEFLPQRRLHANPPTLAGSRPHTYRWRGRDKSDGRLNAMTLASGLDDYPRATVPGEGERHLDLLCWLAFFSRFLAQLSERTGDGGEAARYREEHRAQLASLEQHHWSPGLRAYCDWGRHANAGRFVQLVVVKCGTADGGSAVEHTVSDPERPDCPRSHPRFLFPLGDGKGGLLTRAKLQPRGLKDQHVEHLGYVSLFPLLLRLLPPDSPSLPHVLDLLRDPDRLWSPHGLRSLSKADAMWYGRENAPGDAPYWRGPIWVNLNYLCLAALRHYAQAAGPQKERSAALYAELREALVGTMVSEWERTGYFWEQYDPDTGRGQRTHPFNGWSSLGLLALAEVY

The invention claimed is:

1. A *Trichoderma* or *Myceliophthora* filamentous fungal cell which produces a human antibody comprising mammalian-like neutral N-glycans, the *Trichoderma* or *Myceliophthora* filamentous fungal cell comprising:
   i. one or more mutations that reduces or eliminates one or more endogenous protease activity compared to a parental *Trichoderma* or *Myceliophthora* filamentous fungal cell which does not have said mutation(s) and wherein endogenous protease is selected from the group consisting of aspartic proteases, trypsin-like serine proteases, subtilisin proteases, glutamic proteases, aminopeptidase proteases, sep proteases, and sedolisin proteases;
   ii. a polynucleotide encoding a heterologous catalytic subunit of oligosaccharyl transferase;
   iii. a mutation in the gene encoding dolichyl-P-Man:Man (5)GlcNAc(2)-PPdolichyl mannosyltransferase (ALG3) that eliminates the corresponding ALG3 expression compared to the level of expression of ALG3 gene in a parental *Trichoderma* or *Myceliophthora* cell which does not have such mutation;
   iv. recombinant polynucleotide for expression of at least 2 distinct genes encoding a-glucosidase II, where the α-glucosidase II is selected from the group consisting of an, α recombinant polynucleotide encoding a *Trichoderma* α-glucosidase II, a recombinant polynucleotide encoding an *Aspergillus* α-glucosidase II catalytic domain, a recombinant polynucleotide encoding a microalgae α-glucosidase II catalytic domain, and a recombinant polynucleotide encoding a *Trypanosoma* α-glucosidase II catalytic domain,
   v. a recombinant polynucleotide encoding an N-acetylglucosaminyltransferase I (GnTI) catalytic domain,
   vi. a recombinant polynucleotide encoding an N-acetylglucosaminyltransferase II (GnTII) catalytic domain,
   vii. a recombinant polynucleotide for increasing α1, 2 mannosidase activity; and,
   viii. a recombinant polynucleotide encoding said human antibody,
wherein at least 90% (mol %), or at least 95% (mol %), of the total neutral N-glycans of said human antibody are Man3, GlcNAcMan3, G0, G1, G2, FG0, FG1 and/or FG2 glycoform, and less than 10% of the total neutral N-glycans of said human antibody are Hex6 glycoform, wherein Hex6 has structure of FIG. 1.

2. The *Trichoderma* or *Myceliophthora* filamentous fungal cell of claim 1, wherein the total protease activity is reduced to 40% or less, or 6% or less, of the total protease activity of the corresponding parental *Trichoderma* or *Myceliophthora* filamentous fungal cell in which the proteases do not have the reduced activity.

3. The *Trichoderma* or *Myceliophthora* filamentous fungal cell of claim 1, which comprises a mutation in a protein O-mannosyltransferase (PMT) gene that reduces endogenous O-mannosyltransferase activity compared to a parental *Trichoderma* or *Myceliophthora* filamentous fungal cell which does not have said mutation.

4. The *Trichoderma* or *Myceliophthora* filamentous fungal cell of claim 1, which is deficient in outer CHain elongation (OCH1) activity and/or Endo-N-acetyl-beta-D-glucosaminidase (EndoT) activity.

5. The *Trichoderma* or *Myceliophthora* filamentous fungal cell of claim 1, wherein said catalytic subunit of oligosaccharyl transferase is a *Leishmania* oligosaccharyl transferase catalytic subunit.

6. A method for producing a human antibody with mammalian-like N-glycans, in a *Trichoderma* or *Myceliophthora* filamentous fungal host cell, said method comprising:
   i. providing a *Trichoderma* or *Myceliophthora* filamentous fungal cell according to claim 1,
   ii. culturing said *Trichoderma* or *Myceliophthora* filamentous fungal cell to produce said human antibody, and,
   iii. isolating said human antibody.

7. The method of claim 6, wherein at least 90% (mol %), or at least 95% (mol %), of the total neutral N-glycans of the mammalian-like N-glycans of said human antibody are G0, G1, G2, FG0, FG1 and/or FG2 glycoform.

8. The method of claim 6, wherein said human antibody is selected from the group consisting of an antibody, an immunoglobulin, a protein fusion comprising an Fc fragment of an immunoglobulin, and a glycosylated antigen-binding fragment thereof.

9. A human antibody obtainable by the method of claim 1.

10. A method for producing a *Trichoderma* or *Myceliophthora* filamentous fungal cell which produces a human antibody comprising mammalian-like neutral N-glycans, the method comprising:
   i. introducing one or more mutations into the *Trichoderma* or *Myceliophthora* filamentous fungal cell that reduces or eliminates one or more endogenous protease activity compared to a parental *Trichoderma* or *Myceliophthora* filamentous fungal cell which does not have said mutation(s) and wherein endogenous protease is selected from the group consisting of aspartic proteases, trypsin-like serine proteases, subtilisin proteases, glutamic proteases, aminopeptidase proteases, sep proteases, and sedolisin proteases;

ii. introducing a polynucleotide encoding a heterologous catalytic subunit of oligosaccharyl transferase into the *Trichoderma* or *Myceliophthora* filamentous fungal cell;

iii. introducing a mutation in the gene encoding dolichyl-P-Man:Man(5)GlcNAc(2)-PPdolichyl mannosyltransferase (ALG3) that eliminates the corresponding ALG3 expression compared to the level of expression of ALG3 gene in a parental *Trichoderma* or *Myceliophthora* cell which does not have such mutation, iv. recombinant polynucleotide for expression of at least 2 distinct genes encoding a-glucosidase II, where the α-glucosidase II is selected from the group consisting of an, α recombinant polynucleotide encoding a *Trichoderma* α-glucosidase II, a recombinant polynucleotide encoding an *Aspergillus* α-glucosidase II catalytic domain, a recombinant polynucleotide encoding a microalgae α-glucosidase II catalytic domain, and a recombinant polynucleotide encoding a *Trypanosoma* α-glucosidase II catalytic domain, v. introducing a polynucleotide encoding an N-acetylglucosaminyltransferase I (GnTI) catalytic domain into the *Trichoderma* or *Myceliophthora* filamentous fungal cell, vi. introducing a polynucleotide encoding an N-acetylglucosaminyltransferase II catalytic domain into the *Trichoderma* or *Myceliophthora* filamentous fungal cell, vii. optionally, introducing a recombinant polynucleotide encoding a α1,6 fucosyltransferase activity and a recombinant polynucleotide encoding a GDP fucose synthesizing activity, viii. introducing a recombinant polynucleotide for increasing α1,2 mannosidase activity into the *Trichoderma* or *Myceliophthora* filamentous fungal cell; and, ix. introducing a recombinant polynucleotide encoding said human antibody into the *Trichoderma* or *Myceliophthora* filamentous fungal cell;

wherein at least 90% (mol %), or at least 95% (mol %), of the total neutral N-glycans of said human antibody are Man3, GlcNAcMan3, G0, G1, G2, FG0, FG1 and/or FG2 glycoform, and less than 10% of the total neutral N-glycans of said human antibody are Hex6 glycoform, wherein Hex6 has structure of FIG. 1.

11. The *Trichoderma* or *Myceliophthora* filamentous fungal cell of claim 1, wherein the recombinant nucleotide for increasing α1,2 mannosidase activity is an endogenous α1,2 mannosidase.

12. The *Trichoderma* or *Myceliophthora* filamentous fungal cell of claim 1, wherein the recombinant nucleotide for increasing α1,2 mannosidase activity is *T. reesei* α1,2 mannosidase or *Myceliophthora thermophila* α1,2 mannosidase.

13. The *Trichoderma* or *Myceliophthora* filamentous fungal cell of claim 1, wherein the *Trichoderma* or *Myceliophthora* cell further comprises a recombinant polynucleotide encoding a α1,6 fucosyltransferase activity and a recombinant polynucleotide encoding a GDP fucose synthesizing activity.

14. The *Trichoderma* or *Myceliophthora* filamentous fungal cell of claim 13, wherein the GDP fucose synthesizing activity comprises GDP-mannose-4,6 dehydratase (GMD) activity and GDP-4-keto-6-deoxy-D-mannose-3,5-epimerase/4-reductase (FX) activity.

15. The *Trichoderma* or *Myceliophthora* filamentous fungal cell of claim 1, wherein the yield of the human antibody is at least 0.5 grams per liter.

16. The *Trichoderma* or *Myceliophthora* filamentous fungal cell of claim 1, wherein N-glycosylation site occupancy is at least 95%.

17. The *Trichoderma* or *Myceliophthora* filamentous fungal cell of claim 1, wherein less than 7%, less than 5%, less than 3%, less than 1% or less than 0.5% of the total neutral N-glycans of said human antibody are Hex6 glycoform of FIG. 1.

* * * * *